United States Patent 11,549,145 (METHODS AND COMPOSITIONS FOR INHIBITING AND TREATING NEUROLOGICAL CONDITIONS) - sequence listing, part 68

SEQ ID NO: 1489 - DNA, 340107 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctc

SEQ ID NO: 1490 - DNA, 340107 bp, Homo sapiens; identical to SEQ ID NO: 1489

SEQ ID NO: 1491 - DNA, 111150 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttattt

SEQ ID NO: 1492 - DNA, 111150 bp, Homo sapiens; identical to SEQ ID NO: 1491

SEQ ID NO: 1493 - DNA, 254127 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttct

SEQ ID NO: 1494 - DNA, 59561 bp, Homo sapiens
tcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccggctaacacagtgaaaccctgtctctactaaatatacaaaaaattagctgggcgtggtggtgggtgcctgtatcccagctactcgggaggctgagacaggagaatggcatgaacccgggaggcggagcttgcagtgagccgagatcgtgccactgcactccagcctgggcaacagaccaagactccgtctcaaaaaaaaaaaaaaaaaaaaaaaaaaaagatttcagaacaaagataaacatgcactgcagtgtcataactgcagaaacactgagacagcccagctgtgcagccccgagggacgggatcagtaaactatggtacatccctgtgatgtcccatgatgtagcaattaaaagtgcttccaaaaaacaacatgggaagtggtgcaaataaactaggtagaaaaaaggaaacagtataagcaatatgaattcaattgcatgaaaaacaaaaacaggccgggcgcagtggctcaaacccgtaatcccagcactttgggaggccaaggcaggcggatcacgaagtcaggagatcgagaccatcctggctaacacggtgaaaccctgtctctactaaagatataaaaaatcagccgggcatggtggcaggcacctgtagtcccagctgagacgggaggctgagacaggagaatggcgtgaacctaggaggcgaaggttgcagtgagccgagactgcgccactgcactccagcctgggcgacagagcaagactccgtctcaaaaaaaaaaaaaaaaaaaaaaaaaaaaatctaagtggccaggtgcagtggctcatgcctggaatcccagcactttgggaggctgaggccaaaggatcgcttgagcccaggagttcaagatcagcctgggcaacatagtgagatcccaactctacaaaaaaatacaaaaaaattagccaggcatggtagctcacacttgtagtcccagctacttgggaggctgaggtggaaggattgcttgagcccaagaggttgaggctgcagtgagctgtgatcacaccactgcattccaacctggacaacaagaaagaccctatcagtcaaccaataaaacatcactgcggcttgcttggttgaaaaaagaaaaaaatctccatggctttctgcctctgaaggtgaggcaggaggatatcaccggcaggccatgtgacctcgcagggctgggcatggacccaccaggcaggaaaccacactgcccaccatctccccagacctgctcctgcccgcggcacaggacagaatctctgaggaccagtgcctctcggtgtgggcctctcgccatgcccacagcgcagccccaacacacaccaattacccagactcatcctttttccgaggatctgcttccatttcaacactggagagaaaccggtgggcagagaaacactgcaggcacgttgggggctccaacaaggcccgttccatggcatgctgcacgtggtgggctcttgagagacctccagggctccaaattccagctgaatcctcaccccacaggctccctctgaaacctgccctatgtggctgccaatctaccccaccctaaaccatcaacagcagtcatctctaggtgagagcacaggtcacttgaatgtgctctagtaaggaaatactacttgcattaggggaaaaaaagccagtaagcgaggttttgaataaagactatttggtgagcctggggccagagtggggaagtgatagctactgatggagaacctggagccagcacactggagtcccctccacacagggctggcctgctgcagggctgcagtcacaaccctggggcacaggtgggcaggtctggctctgcggcccctccccctatccagactccagcctcagccatgaccagccacccccaccttcttctggaccacaagcttcagaggccaggccagcacctggaaggctcctgagggcccccatgtgcaggccgggcttccccgaccacctctgctctcagctccatgggccacggctagggccctctgggggcaaaggagcaggtaggggccttgtccccagcagggtcctctccccgcggcccgaggctcacctgatgagtgcgctctcctgcagcagctcccggctgaggttcaggggaatgtcctcactgtccaccacacctgggagacacggcagtcagcttctcccggggctgcggccctccacaccacccaacattccccattaacctgccctttgtcttcaggcctggccttcaacccagcacgtgtgctaagagggaagcagggaggcggcactgccggagcttcctctacgtcctgccacctcccagaacagtgacctgggctgtgggtggccgggacagcctcggggtaacactcggaaaatgacagcctgggctttatgttaaaaatcacaactctggctgggcacagtgtctgacgcctgtaatcccagcgctttgggaggccgaggtgggcggatcatgaggtcaggagttcgagaccagcccggcaattatggtgaaaccccatctctactaaaaatacaaaaattagccgggtgtggtggcgggcgcctgtaatcccagctactcgggaggctaaggcaggagaatcacttaaggaggttgcagtgagccacgattgcaccaccgcactccagcctgggtgacagagcaagactcgtctcaaaaaacaaacaaacaaaactctatcagggatggttcgcacctctgtgtaccaaggcttaaatactgaagtctttcttaaactataatctcactcaaacgtaacacaactcacatatcaatctgaaactcagtatccctacatatggaaagacctcaatctgaacaccccagtgctccccccagatcagtcatgtgcgtagggaggtggggcagctcccggggtctgtaaacgcgactgacacacaggcagcgcaggccgacggcggtgctctcgctgcagagggctgctgagaatggaatcagcacggtccctcacagatgcagcgggcgacactgggccacgggggcactgctcacggactctgagcagcgtacctcggatgaagcgcagccacttgggcaggatgtccgtggccttggtctggatgaggactttgcggctgtacagtgcaacgctggagcccagctcccggctcacatcaaacatggacggtttctgggggtgaggagaacacgccatcatgcagcactgaccctccccaggcaggccctggctgggaggtgggggcggacacgatgaatccagagcccactcccgcctcgccctcccccagcgtctgctctgagttgaagcccagtgcaggggccccacgatgccccacactgtggctctgcaggggctgaaggccttctctggcagctgccgccctccccagcccaccccctaaggaggacacaagagagtgaaccttgcacgtacccctgaacacactgaacacagccaaaccttgctacaggtcagggatcagcaaagagccctccgaccagatccagctcactgcctacctctgtgtagcctaagagtggtttttacactttcaaacagttgaggaaagatttcaaaaaggatgatctcatgagacgtgaagatgaaactcaaatttcagtgtctacgcagctcatgggacccggccctgtgtgctcagagggcagcagggcagtgctgcttcctcacccggcagggttagtggctacgaaagacaccgggcccgaaacgctgggaccagctcctgtctggccctcgtggaacgtgcctgccaacacctgctccacactggtacttcccgaaccgggacccacacctcatcacgggatctggttaaaatgcggcgggtatctagttcaaatgttgggagacctggttaaaatgtggggcgacctggttaaaatgggggggatccggttaaaatgcggggagatcttattaaaatgtgggctcccacgcaggagccctgggtggggcctgagactctaacaagcccctggaggccacacctggctggctctttccaagatggatgccagctgtgcaggacattaggagagtttccaggcagccaaggacagaagagcctgggggcaggacgggctggctctcagccccgaataggtctccttacggcaggatttgcgggaacttcaatgtggtaaaggaaaccaggggaggtggagggtgtggaggaagcacacagagaggccaacggagaggcaagaccacaggcccttcccagagcgcctggcaggacagcatccactgatccacagcagatgatgtaggctctgagggccctccccaggcacaccccagtccacaagcctccaccccagcctgcactgagatgcccatcaatccttccctcgccatgtgtgacccctgagacagaggaaacctctgtggttacccacccagaggcatctgttctttttttcttttttttcagagatggggtctcactatgttggccagcctggtctgcaactcctgggctcaggtgatccaccctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacggacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggaagtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtggtagagctgggcccctgtctcatccccacacccaggtctcatctccacagagcagctcgccctgtgactctgggccgcatcccctgggctcatctcttctccgctgccctgaaacgtacagatttgtctccatgtttgaccagtccctagaggaactcagggctcacctgcaaggtgttcatccgccttccattcaagtacaaggggaagctgacgaagttgctgtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaagaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggcctggggcactgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctcacctgctaaaaagccctcggagccaggcgtggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcaacaagagtaaaactccgtcccaaaggaaaaaaaaaaaaaaaaagcccccagcaggctcctcaccctatagaggcagaagtgggctggggagacaaagccaggaaatgccagggctgggaggaagcagaatgagctcttgcagaaggtcggtcacaggaggctgcatagtgtccaccaggcgacaggccagtcctgcagctcagccactgagaaaggagctcagcgcgggccggacctgccttcccgagcgcagtggtggtgaccaaccacatgggaccagacaggtgccataggccacctggagccacaaaagtcactaactccccaaaatgggagagtcagatttcatataaaaagcccagaaaatgcctgtgtacgttttctgagtccatccctttccaaactccatgctaagggctccagctcagctttgagctgcctgtcaggcgacattcgtcactcacccatctgaaagccactggtaacccaggctccccggggctgccgagcgggaatagacctccactctgtcagccaccatgaaagctgagtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccatttgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacacgcccactgccctggcccacgttgtccgatggaactttctccaacaacaggaacgttctgccaggtgcaatgcgacagcctgccgagcacctgcaatgtggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagcgcggtggcgtgatctcagctcactgcaacctctgcctcccgggttcaagtgattctcccgcctcagcctcccgagtagctgggatgacaggtaccaccaccacgcccagctaatttttgtatttttagtagagacggggtttcaccgtgttagccaggatggtctccatctcctgacctcgtgatccacctgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacagcacttttctgcaaagtcgattccctgagccttgtgggcttgacgcagagagggtcagagggatcagtcccctctcacacagcgccgtgatgagaacgggcttgggatgcggcgtctgtgggtttgatggttctggtcagaactgctctgtgggtctgggcatagtgacgtgcacctgtagtcacgcctcaggaggctgaggctggaggatagcccggccaacatggtgaaaccccgtctctactaaagatacaaaaaattggccaggcgtggtggctcgtgcctgtaatcccagctacttgggaggctgaggcaggagagttgcttgaaccgggaggcagaggttgcagtgagccaatacagttggtcctcctatctacgggttccacatttgcagattcaaccagccaaggatcgaaaatactcagaaaaaaaataaaaaacaacacaatgataaaaagtagtataaaaaacataactatgttatatctatatctagcatttacattctatcaggtattataactaacctagagaccatctaaagcatacaagaagatgtgtctacaatatacggcaccaatttaatccgggactggagcatctgcagactttgctatccaaggggggtcctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttgcaccctgaggggaagggggaggctgtgtgggggccccacgcttacctttgaccccgatctggcaatcgtccccaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgcttgagcccagtgaacccaggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaattagtatctagttgatatcagtcattaaatataagtttcatttaagtgtttaatacatcagaaacttaaatagagtccttaagggaaaggttaatgttagaccaaggtaaaggaaaaaatgcaactaatagctcctattttcaatttatttttattttttcccaaactgatctgcactgcaatcccagtctaaatcctcacaggttttgtagaaaatgacaagccgattctaaaatgtatatggaaatacaaagaacttagaaaattttcaaaatattttgaagaacgaagttggagaatttaaaatacctaattttaagacttcctataaagctacaataattaagacagtgcgatgtgggcatttaaggatcgacacatggatgaaagaaccaaacagagcacaggaacagagatgcacagagagtgtattacttgatttttgacaaagattccaaggtaattcaatgggggatgataggtctattaacagatagtactgaaacaactgtacacccataaacaaaacataaacctcaagccctacctcacaccatacacaaaaattaacttgaaatggatcatagatctaaatataagagctaaagctataaaacctctagaagaaaacatagggctggacacaacagctcacatctgtaatcccagcactttggaaggtcaaggtgggaaaattgcttgagcccaggagtttgacaccagcctgggccacaaagcaagaccctgcctctacaaaaaaaaaaaaaaaaaaatttctcgctctgtcacgcaggctagagtgctggagtgcagtggtgtgatctccgctcactgcaccttccgcctcccgagttcaagcaattctcctgcctcagcctcccgagtagctgggactaccggcacacgctgccacacccagctaatttcttttgtattttcagcagagacagggtttcaccacgttgcccaggctggtcttgaactcctgagctcagacaatctgcccgccacggcctcccaaagtgctaggattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcacaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgttgcccaagctagagtgcaatggcgcgatctcagctcaccacaacctccgcctcccgggttcaagcaattctcctgcctcagcctcctgagcagctgggattacaggtgcacaccaccacatctggctaatttttgtatttttattagagatggggtttcaccgtgctggccaggctggtcttgaactcctgacctcaggtgatccgcccaccttggcctctcaaagtgctgggattacaagcgtgagccactgcacccggccataaggtttcaatcataagggaagctgggtgttggagtagatggcaacgctgtactatctttaaaatttttctgaaaattgaaatctgttctaaaatatttactaaaaaaaaaaaaaaactatagatttttcagatgtagacagaaatcatctgttgccaggcgacccgcacaatgtgattttaaaaggaaatggtgagactaggcgcggtggctcccgcctgtaatcccagcactttgggaggccaaggcagtcagatcacttgaggtcaggagtttgagaccagcctgaccaacatggtgaaaccccatctctactaaaaatacaaaaattagccgggtgtggtggcatgtgcctgtaaacccagctacttggggggctgaggcaggagaatcacttaaatccggggggcagaggcctcactgcagtgaggtgagatcataccactgcactccagcctaggcaataaaatgagactctgtctcaaacaaaaataaaaaggaatttgtgagggtttacaacaggtatatacataaaatatttgacatcaaaagaaaaagatgattttgccaccggaatgatactgttgtaagattcttacaatgaagtgttaaatatcaattcaagctagacagtgataaattaaggctgcatattttattccctagaaaatcccctaaaaataacaaaaagcaatgtagctgagatatcagtagatgagatggaatggcataatacctctgagaccccacaagaaagcttccttttctaaaactttaggtaagaataatctatcaatattagttaattaattgtaataaatgggctgggtatggtggctcatgcctgtaatctaacacttgggaggccaaggcgggcagatcacttgagggcaggagttcaagcccagcctggccaacgtggtgaaaccccatctctactaaaaatacaaaaattagttgggcatcatggcacacatccgtaatcccagctactcaggaagctgaggcacgagagttgcttggacctgggaggcggaggctgcagtgagctgagatcacactactgcactccagcctgggcgacacagccacactctgtctccaaaaaaaaggaaaaaagatgaaacaaatggaccatgacgctcccatcggctattgagaatagaaaaactgggtcccaaaggatataatggagctctaaattacctgctcaaattttctgtaaatctagaactgttctttaagaaaaaagaagacaaaagacaaaaccaaaaatcattattgtaacataaatggtcttagtaccaggaagtactggcacatgaggactggcccctctgctaaagaccaagaatcatgtccccatgaccccttgccccagcacatccattttcaatcatctgcaaggaacctctgtgctgaaaacaggaggaaagcacagggcgctgcagccctgcccacagggcccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgcctgcattcatttatgtggcatgaccttcagagcaagccagcaccctaaaagggaatactcagatcccaccgaggccagtctgtccacctctccacagagacagacacccccgcaatgacgccgtgaccctgggatgacaggtcctgaggcagctgtctttggatgcaatgtctctcagggcccctacctgatcctctttggcctaacttttcagccttaaaatttccacaaggctacagcagcagccacagcactgcttcgtcggcattttgaggggaaaacgcagttaaaaatatgaaaagagtacattaaaaataagatatgtttagatatgttaatacctgcatataccaaaaccctgtgtggccatatgctaagatgttaccagtagttattgctggatgatggggtgatttcaaattttcttcttttctgcttacctgcttttccaaaattttctataatgaatgagtgctactgtaacactaaattatagccagagttatcctggtggtacggacggccagtacgtccctgggacccgagacatcactagaaggcggatcctgtccttgctgcatggccgggcctgccacacgcctggacactgagggaggtacctggatggtgatggtgcctttctcggcattggtctgcaagtgaatctccatttctggcagtgcttggccgtcagacaccagtttgtgacgcagtttttccaaggcatcgctggcattggagatcagctcccgtataaacacctacaggaatagaaatgggaggcacagacaatgaaggacactcatcctgcaggatctatctggtcagctgcacttccaataactgttaaaaggtagaggagaatagtcaattctcaaagcataaagagtttctgctttagtcaaaggcagttcctctgggccggtcacaaagtgactgaaggtgctgactttcctttcaggatttctttgagagtctcactctgtcactcaggctggaggctgcaatcacggcttattgcagctttaacctcctggacccaagcaatcctcccacctcagcctcctaagtagctgggcccacaggcatgcaccacacccagctaattgttttaaaatttttatagacacagggtctcgctatgttgcccaggctggtcttgatctcccaggctcaagtgatcgttgtgcctccgcctcccaaagtgttgggattacagacgtgagccacggtgcctggcccttttcaggatttttaatcaagcctgaagttacgtgtccatctgttaattataactttaagaagagccctctggctggggttgggggctcatgcttgtaatccaggcactttgggaggctgaagcaggtggatcacttgaggtcaggagctcaagaccagcatggccaacatggcaaaacccagtctctactaaaaatattaaaattagctgggcgtgatggaacacacctgtaatcccagctactcaggaggctgaggcaggagaatcgcttcaacccacaaggcggaggttgcagtgagccgagatggcaccactgcactccagccccgacagagagagactctgtctcaaaaaaacaaacaaaagaggcctgcgaggaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgcccagtctcaggtatgtctttatcagcaacgtgaaaatggactaatacactcctactccacaaaaacaggttccctagcttcatctcatctagtggggaccaccaaacaccaggtctaccacacccggagaaaaacaggcctcagggcccagctgtccctcaggagctgaaaagcacactgacctcaaacagaccttccatttaaaatcagtgagagaggccgggtgtggtggctcacacctgtgatctcagcactttgggaggctgaaacaggcagatcacctcagcccaggagttcaagaccagcctgggcaacacggcaaaactccgtctctacaaaaaaatacaaatatcagccagaggctgaggaggaaggatggcttgagctcaggaggcggaggttgcagcgagccgagatcataccactgcactccagcctgggcgtcagacccagaccctgttccaaaaaattaaaaaaccaaaaaaaaaaaaaacaaaaacccacacaattaaaaatagaaaaattaagtccgcaagagcacataggtgaagaggaagcggtggctgatctgggcggaagctggaggtcactgggagtcaggaatgcagcactcatcagtacgaaacccggaaacagctcctagaaggccctctgagctttgaaatctgctgctttacaaactttcttcaggactctcctttgccttccagcaataatcagcatgtcaacgatggtggccttcatctttctttttccttgtcctgtcaccccaaatgagttttgcggggttttttttaatagagatggggtctcttcacgttgcctaggctggtctcagactcctggactcacacaatcctcctaccttggcctcctaaagtgccgggattacaggtgtgggtcaccgcacctggccccaaatgcgttttaatttcctcagtaactcctccctgctccatacacacaggactggggaaccttcttcctccggcagccaaagccgccaagacctgcaggtagtcccaccaggcaaaggggcctcagagcgtatccaaagctccacagagacggaattcagcagagctgcacgctaggatttgggggactttttttttggagagagggtcttactctgttgtgcaggtcagtgtagtaacacaatcatggctcactgcagccccaaagtctgccaggctcaagtcatcctcccaccccagcctcctgagtagctgggaccacaggtcagtgcccccatagctggctaattttttaaattttttgtagagacggagtcttgctgtgttgaccaggctggtctcaaactcctgggctcaagtgatcctcctgcctcgacctcccaaagcactgagttcccaggcatgagccaccacaccaggcctgtatttcgggaacttttaaaattattggcaaaattcaattaattcccagagttgatccagcccaaagaaccatctggatacacttatccaggaaaccaaaacagattctggtaaaactcctctcactggtagcttaagatgaggacctgtccaaagtttaatgctttctcacagctaatatattatctggcaattctccagaatggcataaaaaccagctttgtgaaaagaaactttgctagcatcgggcatggttagcagggaacgcacctctttttctgagtacagggaccgggcaacaatgtccaaaagcttctttgtctcggcctggaactcatgtttggaagtggaacctagtaatgaaacacagacacaaccaacaaagtttaacttctatttttgtgcaagaatacgctacgtcacattccaaagaaagcttaagtttatgagttttaaacttttttttttttttttttttgagacggagtctcgctctgtcacccaggctggagtacagtggcacgatctcggctcactgcaagctctgcctcccgggttcacgccattctcttgcctcagcctcccgagtagctgggactacaggtgcctgccaccacgcccggctaattttttgtagttttagtagagacggggttttaccatgttagccaggatagcctcgatctcctgacctcatgattggcccgcctcggcctcccacacatttaagatcatgaacaaaaagaaagaagcagacagaaacaaagtctggctgggcaccatggctcatgcctgtaatcccagcactttgggaggccaaggcaggagaatcacttaagcccaggagctcaagaccagcctgggcaacacagagggatcccgccatctctacaaaaaatacacaaagtagctgacggtggtggcacacacttgtggtcccagtgactcagggggctgaggtgggaggatcacttgagccagggaggtcgaggcttcagtgagccatgattgcactacagcactcggcctgggtgacagagaaagaccctgtctcaaaacaaaacaaaacaaaaagtctctcagaaaggaggtctcagggcaggacaaatcctcccactgctgaggccagacatgcctcgggctatgtcgagggaatgctgagcctggtttcccaatgtgcatggttacgagaactggactgcctctaagaaccagattatatgttctttcttttttttttagaggcaggatctggctctgttgcccaggctgctatgcagtggcaggatcgtgctcactgcagcctcaacttcctgggctcaaccgattctcctgcctcagcctctcaagtacctggaaccactggtgtgtgctaccatgcctggctaactttttaatttttttctgtagagaaagggtctatcttgcccaggttggtctcgaccacttggcctcaagcaatcctcctgcctcggcctcccaaagtgctgggattacaagtgtgagccactgtgcctggactatattcttcaaaaaagcggtttccaaattaattagttagaaatcaaaataacaagaaaacctcacttctctttttaacttcaaagattctactcttgtcgacccacttaaaagccagaaatggagccacttcaggactggctccaaagactgcttttttatacttcagagggaatgaaaagacagctccagaattcggtcctgcgcagactgggccaatgctgagtttcccctcccgcttccatgattattagcagatgtgccatgaatcaccactcaggggaggtgccggacggcaaactcacgggtggccaccagagggggcaagacacacccgacactggcagaagtccctcgctgggacagaaatggagggcgcagcactccctacagccaagaccttctgatttcacacctaaggcggtggctctaccaatcactgcctccaccctgaaaatgcccctttacgcacagcagtgaaccaaaaagccctcccagaccaaagcacgagccaaggctaccctgcacgctctctgtgctgctgataatcgagtgcaggggttcctccttgtcctcggcggtctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtgtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagctgggatgacaggcgtgagccaccatgcccagctggcagatgcctgctgacagcacttcccacattcgcctcacgggtgacacctcgcatcaacctaccaaactgaaacctgtctcgaccctcgcagcccctgcagaagcccccgatgggccacacttctttgctcttgacagtcaagcaaaaaaaaaatcctcccaaaagggatccaaatatttaaatgttaatattctgaaactgtctcatcttctaaaagttgattctttcccattgctttttcatccaaaacagattttttaaaaaaaatttgtgtactttaaaaactgaaaaacagctgacgatgggttctaccttctaactaagaaggagacttgtcttctgtaacttcctgctcagtccagtgggctgagaaagttgccggcagagcccagcgagggaggaaagcagccaatgtgtccccagccgcacgcagttcaccgacgcaggcccagaaaccagacactttcactccaacacaggactggaccgacccaacaccaacacccactgaccccagggaccacataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggccaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctgcagtgcaatggtgcaatctcggctcattgcaacctccacctcccgggttcaagcgattctcctgcctcagcctcccgagtagctgggtttacaggcgcctgccaccacacccagctaatttttgtagttttagtagagacagggtttcaccatgttggccaggctggtctcgaactcttgacctcaggcgatctgcccacctcagcctcccaaagtgctaggattacaggcatgagccaccgtgcccagccaaaacttgcctattctttaggcttattcctggacttacaaacagcacaaacctggccttttgtttttgtttttttttgagatggagtctcgctctgtcgcccaggctggagtgcagtgatctcggctcactgcaacctccatcttctgggttcaagcgattctcctgtctcagcctccaaagtagctgggactacaggcaccagccaccatgcctaatttttgtatttttagtagagacgaggtttcaccttattggtcaggctgctctcgaactattgacctcaggtgatccacccacctaggcctcccaaagtgctgggattacaggcgtgagccaccatgcccggccaaccctagcctgtctttatctctatgcagataccttaaaaacatctaccacaattcagaaagtattcaaattccaaaccatgtaaacatccagttatttgggcccatgtaattgcattgttcactttattcgtacagttaaaaaaaaaaaaaaaatcccgggacatttcttctggaattaaatggtatttggcattagaggagttcgcgaacagtctacatcaaaccagggtgctgaagtctctgtgcctccttccaaagcacagccagccctgggggcacaggagggaagtgtccaagtgccaacacctgcccacagagcatatcagtgtttctcaccatttgtgtaaaagaaacacaaaaaggataaaccagaaactgatgtgactgtgtattttgtttcctaggactactgaaacacagcaccacaaactaggcagtttcaaaaaggtccacagttctgagccaggcacacaacctcacacctgtaatcccagcactttgggaggccaaggcaggagaatcgcttgagcccaggggtttaagaccagcctgggcaagaaagtgagactccatctctgcaaaaaacacaaaaactagccaggtgtagtggtgtgcacctgtagtcccagctacttgtgaggctgaggtgggaagatcacttgagcccaggatgttgaggctgtagtgagccaagatcacactaccgcacttctgcacttcaggctgggtgagacagcgagactctgtctcaaaaaaaaaaaaaaaaaggtcccaggttctgggcagcggtgcttcccactggaggtgccgagggagagtccatcccgcacctctccccagcttctggcagtagccggcatccttggtgtttcatgctttgcagaccctccaggctctgtctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttgagacagagtctcgctctgtcatccaggctggagtgcaggggcatgatctcagctcactgcaacctctgcctcctgggttcaggcgattctcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaatcctcccactttggcctcttaaagcactaggatgacaggtatgagccactgtacccggccttcaaaccccacagcttggttacctacaggaggtgtgtattaaactccccgtggcacaaacccggtagcttacagtaacagacacttattctctcacagtcctggaagcaagaagtccaagatcaaggtgccactagggctggttcctcctgaggctgggagggagggtctgtttgcgcctcttccagcctctgcagcctctggcgttgcttggcttgtgggtggtcatcttctccctgtgtcttcccttcaggacgtctgcccttctccctctacacatgtctgtctgttcaaatgtccccattttataaggacacagtcatactggattagggcccacccaagtgaactcatcttaacttgatcacctgcaaagaccctatttccaaatatggtcacattcacaggtactgagagctgggacttcaacatctttcgtggggagacacaattcaacccccaaccagcatatgtacagagaatgcaaagaaagcgggaaggggagagggctggcagagctgagggaacatgacacttccacatacatcttttcgtatgtctctcttagaaccatggtcaggtttctcatactcaaaaaacaaaccattacttagccagacgtggtggcgcacttctagttatcagctactcgggaggccgaggtggaaggactgctcgaacacaggaggtggaggttgcagtgagccgaggtcgcaccactgtactccagacttggcgacagagtgagactctgtctcgaaaaaaaaaaaaaaagaaaagaaaaagaaaaagaaaaagaaaccgtgaaaacaaaacagggcgcacatgaacacaaaatgaaatacaaacagcaaatatgcagagctgtgacgatgacatcaccactctgaaagaagaactaacctaagagacttcagaaaatagcactttgactgttactgtaaaactaacctcagaggacagcacaccatcaccaggctcgggcaggagatgtgtcccctgcggagtcagcaggtctgagcccgatttacgcatgtgccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcctttgtcctggcaaactaggacggctggtcaccctacctggcagccagatcttggtttgtgaatacctctctccaaaaacaggaaccagagatccctgcggagcacacagaggagcctaggacacccagtggtgtgcagaaggacgagaaaggacggggtgtgtcaggagaacacacagcccagccagaagggctcccagtggcagaatctaggacaatctgtgcggcaaaataacgaacgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcctgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctgcctcccaagcgctgggattagagccgtaagacaccacgcccagcctaaggttatgtatttgaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgcagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatttccccatgtttcatttttctagtctttttggtttttccccaattaatatgcagaattttttttttttttcctcgagaaggtcttgctctgttgcccagagctggagtgaaatggcgtgatctcggctcactgcaacctctgcctcccaggttcaagcaattctcctgcctcagcctcccaagtagctgggattgcaggtgtgcaccaccatgcccggctaacttttgtgtttttttgtttttttgtttttcttttttaagtagagacagggtttcaccatgttggccaggatggtctcgaactcctgacctcgtgatccgtctgcctcagtctcccaaagtgctgggattacaggcacaaaccactacacccagcctatatttttgaaaggatttaatataatattcattatgggaggagtatatagaagtcctcacaattgggaaaaagaaaaaaataagaaatctatatttccagccagaattgcaagacttagtatcataacgccaagattacattaattgaattgacagcattcttaaaagcagatttgatttcaggttatgtaaactttccacaacaacttttttttttttttttagagtctcactctgttgcccaggctgcagtgcagggcgccatctcggctcactgcaagctccgcctcccggattcatgccattctcctgcctcagcctcccaagactacaggcgcccgccaccatgcccggctaattttttgtatttttagtagagatggggtttcaccgtgttagccaggatggtcttgatctcctgacctcgtgatctgcccgcctcagcctcccaaagtgctgggattacaggcgtgagccaccgcgcccggcttctacaacaacttttaatcactaactcaggtgcagtggctcatgcctgtaatcccagcactttgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattcttttttttttttttttcctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcacaaaagctactctttacaaacttttttttttgagatggagtttccctcttgttgcccaggctggagtgcaatggcgcgatctcagctcaccccatcctcctcctcccgggttcaagcgattctcctgcctcagcctcccgagtagctgagattacaggcatgtgccaccacgcctggctaattttgcattttttgtagagacggggtttctccatgttggtcaggctgctctctaactcctgacctcaggtgatccgcccacatcggcctcccaaagtgctaggattacaggtgtgagccaccacgcccagacttttttgtttgtttgtttgagatgcagtctcactctgttgcccaggctggagtgcactggcacaatctcggctcactgcaaactccgcctcccagttcaagccattctcgggcctcagccgcccgagtagctgggactacagatgcacatcaccacgccaggctaatttttatatttttagtagagatggggtttctccatgttgcccaggctggtctcaaactctggggctcaagggatcctcctgcctcagcctcccaaagtggtgggattacagaagtgagccaccgcacctggccaagggtgcatatttcaaacaccagagtaaccactaaaataataattcaaagaagaatagctttaaaaagcattagataaaccacaatggaaatctcaaatacatttcattgataaggaaaggaaaaacagggaaaaaatccaaaaggacaaataaaaggcaaataataaaatggtagcaataaatccagccacatcgatatttactcttacattaacagactgaactctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaacctggggcaaaagatatgaacggcatttcacagtggctacagaaagcgaaggagcaccaaactatatatgaacacagcaagctctccacgagctatgtagtgagtaacagaacacagagaagggtgcgtccctgagggaatatgtacatctgcacttactacagtcatacaagtaagtagtggcaggacccacaggcaactaatagtggttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcgacacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctgggaagaagttttttgagaaaagactttcatttttcaagaggcagatcattttaaagaataaggcctagggcagtggctcacacctgtaatcccagcactctaggaggctgaggcaggcagatcgcttgagcccaggagtttgagaccagcatgggcaaactggtgaaaccccgtccctaccaaaaatacaaaaacttaggtggacatggtgacacgcacctgtagttccagctacttggggtacttgaggcggaaggatcacttgagaccagagggtaaaggctgcagtgagccgagatcacaccactgcactctagcctgggtgacaaagtgagaccctgtctttaagagaaatttaaaaagctgggtgcggtggctcacacctgtaatcctggcactttgggaggctgtggtaggcggatcacctgaggttgggagtttgagaccagcctgaccaacatggagaaactccatctctactaaaaatacaaaattagccaggtgttgtcgtggatgcctgtaatcccagctacttgggaggccgaggtaggagaatcgcttgaacccaggaggtggaggttgtggtaagccaagatgctgccattgcactccagcctggagaacaagagtgaaactccgtcttgaaaaaaaaaaaaaaaaaaaaaaagcattcagtaagatggtagaatacaaaaatcaacacccggacgtcctatatacagaaaactagttagaaaatatgacataagagaccccaggaacaaaaactaaacaattaagaatgcatttaccaagaaagcaaaatctttccttttttttcttttttggcaagatcttttaagaaaactctgaaacactactagggccaaagactgtcattaaataacccacttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcacatgtgcgtccaatgaacgaattaacaaatgaaccctcagtgcgctactgggaggcggggaggggtaaagcacgatccatggaactagcacgatcaccccgagtgagtccattccccgcaacatgcacccgcaaagactccgcgctccgcagcggctccacctgcacgtgcgctacctgactggaccgaagctccaggagggacgaccccgcagccgctccgcccgaccccgcgaccccccaagacccagcctccttcagggctcccatgggcgggtggcgaggggagtccagccgaggaaaaggcagccaagctggagctggcgaggagcggagcgaaagtaaacgcgtctgccgcgcttggcctcgccggacctcccacgcctgtgaagcaggtgccggcgcctcgctccccggagcacagggacgtccctgccgtctccgtggcccggcccgcccgctgcccgtccagccaggacgccctcacctcccggcacggccgccagcgccggcgcccgcagcaaaggccgcaggcggcggccccacagcagcagcgcccgcagctcgcgcgccatgtcgtactcccagagcgccgcgcgcagccacgcgggaccgtacacgatgggaaggggcgggacggggctgcgcggggcggggcttcctc

SEQ ID NO: 1495 - DNA, 171403 bp, Homo sapiens
gcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggaggcgcagaggagggaaggagggagggggacgcggaggctgcggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggccgttgtaaatcggagagattctgcggagcggagggcagaggtggcggccgcggggactcgggaggcggagacggagtgggcgtgggggggcccctacccgcgcgaggggaggacgaccacagggagtacgatgccggcagggcctcccccgagtctccagccgtttggttgggagagcctcgtggggggcccatcctccaccggccaccggcgcctccagagatgctgtgtatttggcgcttggctgtgtcccgctgagctccccgcgcgcgcatcgaaatggccccgtctggactgtgcccggctccccggctggggctctctaccgcggtccttcccctccccaccgtcttcccggtgtcggcccggggctgggcatcacgcttctgctcttacagagctgacagcctgcaggggagacacggagacagacacgtaaacaaacagtgctagacacacctccacgcacagaggatgacaaataacacagtgggggcgtcagggagagcttcccggaggaggagacatgtcatttgagaattaagtatgaggaagaattatggctgagggtgtgggatgataggaggaaagccgttctgagcagaggaaacaggaaaacaggaggggagacatgaaattgatgtgtgtgtgtgtgtgtgtgtgtgtgtgtgtgtgtgtgttgatgacaagcaaatttgtttttcaacatcaacattgcaggctcttccagctatggcagagctcacgttgtaaaacctgttccccaccagcaccgctgggtctgttgcttctcaccacctctccccgcaaccccagcccccattttgctagagccagggtagacagatttcattcaacgtccacatttgtggtgaggtctcatcctgcttctcccacaaattggcccatagaaagcaactgcaattagaagattctcttcttctagccccagttccaggctgaaaggcactgctgtcccctcactcacactctttccatatggaaactgggtgatgctgtttctagctgggggcactgggtggacagtggtgctattcaaggtgttaaggagccctggaggagaggctattcaggtgagggtggagatgatggattcaccactgaacccagggactttgaggggtctttgggacattcacatgtcactggcctgggttggggtgcatatcctgacctgcagctcagggggtgaggctggtactggagctacagatttttggtgatttccagcctaagcggagatttaaaaatgtatgtgtagacaaaagtgagaaaaggcacagcgagttaaaggcagactctagacagcacccccatttagggacaatgtttagcccagtaattgttgagcagtgaccactcaataaatatttattgaatagatgaaattttggggtggcacaacacaggaaagaaagaactcgtagatgacaggagagagaagaccatcatggaagggggacatttaaaggcaggagcaatcaacaagtgcttcagtgagctaggtattgtggagtgtcctcagctggtacagccaggaggccgagtgctgctgtgagcagagcagagcagagcagtgccagagtaatcgctggctgtacttgttacattggcttccttagcactggcaggaaatgaacctcctcttttgaaaacttttcctttattgggtatggacttcacaggggcaaatctcaaagataagcaaatctcagagataacgtaagcccttgggtgatttaagttggtttctgacagtaaccagaatgaatggttgaaatccttggaagttattggcactggagaaatattttgctagtcatgggtagtttggtttaactacctgtaatcagtacattaaaaatgaaatgaacagaacgtcttatttagtctttttttttttttttttcgcatgagcggaaataatttatgactttacctgaaaggagaggcatcacagattctctctgggcttcatagccatgttttgtggttaaaagtactcagtagatatgttttaatatgttctagaagtctttctaaaaaatcttgcaatgcaacaatttggtggagaaatcagaccggtttaatataatatgagggagctcaataataaaaaatgccagatgtttttctcagacaacattttaacagcaggttttaattcatacagaacttacctggggcaggggaagggagccccagatgatgtcaatggctaaaataatttccagggatctaggtctggctcagccactgaccagctctgtaaccttgggaacataacttaacccatctggaccttggtttctatctgtatgatgactcagggaatttagaagctatgtttctgttataaaaatgattgtggcaatggtttcacaactctgtgaatatgctgaaaaccactgaattgtacactttaagagaattgtatggtatgtgaaatatatctcaataaagtgatacgaatatgtctctgtgtctctgggtgtgtgtgtatgtatacatctcagtgctgaaattcttaagtaagttaagcatttcagagtaagacaaagatgataaagtggaccttttacagagaagggatccaggaccatggcaaactgagatagttttctgaaagataagcgaggtaaaattagctataacccggttaactgttccttttttcctgataccttccctatctctgggaaaaaacccctactttacagagaatgaagactcgtaaaccctggggattatgcatcattttggcagcacatggagaccaacaggaaagaggaagaaatatgctaaaatgagaagaatataagttaacaaaaaaatttaattaattctaagtttcagcgtttgagactagaacccaaatttttctttttttttttttttctaatatgcattatcctttattaaaatgggatatttttctttttttttttttttaaggttatagattttcttttttttttttaatttttttttttctattatactctaagttttagggtacatgtgcacattgtgcaggttagttacatatgtatacatgtgccatgctggtgcgctgcacccactaaagtgtcatctagcattaggtatatctcccaatgctatccctcccccctcccccgaccccaccacagtctccagagtgtgttattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatggtgagcatttcttcatgtgttttttggctgcataaatgtcttcttttgagaagtgtctgttcatgtccttcgcccactttttgatggggttctttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctagattttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttgctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtttgcaaacagggacaatttgacttcctcttttcctaattgaataccctttatttccttctcctgcctgattgccctggccagaacttccaacactatgttgaataggagcggtgagagagggcatccctgtcttttgccagttttcaaagggaatgcttccagtttttgcccattcagtatgatattggctgtgggtttgtcatagatagctcttattattttgaaatacgtcccatcaatacctaatttattgagagtttttagcatgaaggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgattattgccacaatttcagagcctgttattggtctattcagagattcaacttcttcctggtttagtcttgggagagtgtatgtgtcgaggaatgtatccatttcttctagattttctgatttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcctgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcccggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgagatgtcagtgtgcccctgatggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcccccctcccccagcctcgttgccaccttgcagtttgatctcagactgctgtgctagcaatcagcgcgattccgtgggcgtaggaccctctgagccaggtgtgggatatagtctcgtggtgcgccgtttcttaagccggtctgaaaagcgcaatattccggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcagaacccaaatttttcaagtgcatagttaaatattttttctcttgacaagatttttttgatagagctgtttactcttctggtagagatgtagcttgagctattataaataaatacaaatagcatagatatggcattgtggtttcttgttaaacgtggtacctcaccaataaaaatatagcttacaatatttacatttgtgttaccactcactgatttgtatttgtatgcttatttcatagtaatttttcttgacagcatttattgttgaagaaggaagttcagggcacacctatgtgtgttctgacctggaaagtactaatagtcatattctttccatttctggaccttcttgtcttccagggtccttgttctgcatcccataaaagtccagggaccagtttcatctcttctcctcctctccttctctcccaagactaaccatctactgatgacacttgtgggctccatgttaaatttacttctttatgccttttaacttctgtcatgtgactcagcaacacatgccagaggttaaaggacactgcttgtagggcagaaagaaggggagcctctaacacagtgcttttttacaacttttccccctttctcttttaatgcattagccagaaaaatgataaggggtcatgaggggcctggacgtattccctgtaatcactgactatacaggctggccatttaggggtaaatgcttcagagaaggatattctttgtaaatcatgagattctctagggaggcaatgaatgtctcttgtttcactatctcattagagagaaagataaaatgcactttgcacaatccataatgatttatttttttctcttagacgcatcagaaaatatattaaagctaaaacattcttgctccttttcacatagattgcttgataaactaattgataaatccttttttttaaagtcagggtgtgaagatagatgtttaaaatggattgattttgattttttaaaatatcttaaggatataatacaatccatatatttcttaccactgaggactttttgttctataaagtaaatgtaactcatggtatcacttggaatttgatttaaaaatgcatttgaaagcagggatttttttccctattgctttagtttaatttttcagctttattaacaaacggaatgtaaattaatttcccaaagttaagtgtgtgtgtgggtatctcatgtgtatttggggaagctattactggcatgctttgcccagaagatagaactgtcagtaaacaactgacacactgttcggctaaatagtgaacatattctggagaatctttagcagcaaaatgtggacagttagattttgcttttcaacagaaacctgggaaagtgttgagctgaggggagagtctgagagaagtactattgatgagatcagggaggcattgtttccagttctaactattctagttctttgaaatgctttcccaatgggaattccttcccaatttccagggtcatcccaatgtttttaccacacacagcaccagcagccagtggccttcctgagccaggtgttgttccttctgacttccaaatccagtggataatggtgtcttttccccgtccctggctacatcttcctcagacagtaatgctactaagtactttgcctgttcaaatcatccatccgtggtagaggctgctgatatttcaggctggataacttgagtcctccctagtgaatctgatatccgagtcaaatcttctcatccttgtccacctttctttcttctgggccacaaatcaaaactctggagggtcttgtgagctcatatgtagtgcttcagtgcttctccagtgcaacagtggaagacacacctggctagtcacaccattgtgcttccaatcccatctcctctcattttctcagggactttgctcttgttgccatctcttctctgcactattgtttcttctctcctggataaatttcactgtaggacaaagaagggtgtattagtcagggttctctagagggataggactaataggttagatgtatatatgaaagggagtttattaaggagtattgactcacacgatcacaaggtgaagtcccacaataggttatctgcaagctgaggagcaaggaagccagactgagtccccaaacctcaaaagtagggaagctgacagtgcagccttcagtctgggccgaaggcccgagagcccctggcaaaccactggtttaagtccaagagtccaaaagctgaagaacttggagtccaatgttcgagggcaggaagcatccagcacgggagaaagatgaaggccaggagactcggccagtctagtctttccacattcttctgcctggtttattctagctgcgctgtcggctgattagatggtgtccacccagattgagggtgggtctgcctctcccagtccactggctcaaatgttaatctcctttagcaacacccttacagacacacccagaaacagtactttgcattcttcaatccaatcaagttgacactcaacgttagccatcacactagggtttaagaaaatgatggcaggtctaagcgagtcatggagggtttatgaaagatgggtcttggaaagggagttttgtgtataattgggttggctgggattccggaaaggaatttcagaatttagccctggtttcagggatacactgatgcaggaccagagcaacaagattttctcagaatattgatctacgcctagtaaaaacttgcaagaggatttgattttaattctgaaatcgatttctttatactttcaaccttcttctgaactacagctttttcatgttatacagtttctgcctaatttcaaattgaaagtgctgccttcttcatttaaaatgataatttcatttcttgagatagagttttgctcttaaagctttccagagtcatatctcaagagttcagctttttgccacgtctcacgacatacaatttgcaggtcatgcatcattgccttctgctcttcttccttctctccttgaaaaggtacattttctttttaactggagtggtgactctcactctcaactttttcatcagttcctgtggctgtttcccccccacccccagttctcaccctgttattgtgaccttccctttcccctttccctttccctctcccctcccctcccgtcccctcccctccctccctccctccctccctccctccctgcctccctccctcccttccttccttccttccttccttccttgcttccttccttccttccttccttgacagggtcttgctgtgtcacccaggctggagtgcagtcatgtgttcatagctcactgcagccttgacctcctgggctcaaaggatcctctcactttagtgtcctaagtagctgagattaaagacggatgctgccacacctggctttggcttttcttgatgtgtctaaattgttccatgtaaccaggcaatttcatgtgtctttaatttttctaaaagccatgcattccactgctcaaggtactggtttccttgtttacattattcttctataatgtggtatatactcatgaccttcgacacatacttttccagtgtctaattgaattcaaatactgtttcatcaggttcgacttacagtttatctaaatgagattcccaaaggaagaagtactcataccgtaggaggtttttctttgccttttcagtaaatggcctgggaaacagaactttcatgttttattaagaatttatggtgctttgtgctgtctttattagctttttgattatttagaaaaactgcatcatctttaataagtgatgttcatctttaaaaaattatatgtgtgcggatgtgtttatatgaatattctaaaaactacgtaaactgtataagagtctgatggtcttggtatgatgctgtaaatcatgattctggttgttatcttaaaatacggtacacaggccgggtgcggtggcttacacctgtaatcccagcactttgggaggccgtggcaggcagatcccgaggtcaggagatcgagaccagccagaccaacatggtgaaaccccgtctctactaaaatacagaaaattagctgggcgtggtggcgggcacctgtattcccagctactcaggaggctgaggcaggagaatggtgtgaacccgggaggcggagcttgtagtgagccgagatcacgccactgcacttcagcctgggcgacagagcgagactccatctcaaaaaaaaaaaaaagtactgtacacaatagaagtaactaaatttccttgttaattgtttgttacaatgaattctcatcaaatttttaaccacagctattctaaatttttgtcatccacagttttgatttttctcataaagtcatctgcagtcagattcatggaaaagactctaataagtagccttgaatacatgtttctgataacttaaaaatcaatggattaagtacaaatttccaaaagtctaattaaaataactgacatattcatgaaactgctaaccaagatcaaacagagcaacagttaattacatgggactaaactgataatggattataatttttatgacttttatttaaaatattgctaattctttaatattttattttccagatttaaggaaacttttttcttaaggtacctatagcaatttggttatgtatactcttgtgaataatattaaaatgtttgctttttctccctatcttatctctctaaaattaaaaaaaactattcgtgagtattttttattttatgacaatgtatttacataattttgataaaaatttattttttaaataacaagatacaatttaaaatgttaattatattagcaaggtttgacttagacatcatatttaaaaattcttgtaggtacttcggatacaatctgaagcccaccttgatttggccttcttgcttcagaagttaaaaaaaaaagttcaatctgagattcaatcactattctcactgtacttatgtaaatactcaggacaaatctgataaaactaacttattttacatacaaattagtcttgctctgagtactttggtaaaattgggatgacagtgatataccctttattagattgtagtcttgtgagttgttttcaggttttattatatacttgtagaagggactggatcttaaattcttctaggttcctctaatccaattttctcctatggaatttttaaatagaattactaacaatggaaaccattcttttctaaagcgctgtaagctaaaactaaacatcttaatataaattacaagggacaagccttgtgcctgatatgtgggccacacagaaagttcaccaaaccgcctgatgccatagtcagaggcattcagactgcaaaactgctgacttcacactgtggacagtgtttcccaaggccgttggaacaagacatcataatgagattcttaccccttgtaatgcctcccttcttcacttgacaggataatgccataattaaaatttcacaatcagtaacaattatgagtaacttaacaaaagctgatctaagaaatcccttagtccacttattgagtagctttggcaatatccctaacaactttttgttcatattgtactagtgggcccttttacagagttagcactgtctgctttaatttaacccagtcatggaatactacccaatggctatgccaagtcttacccagtttctccatggtcttttgatttgtttagttgattgcccttaggcttggcagaactattgcataaactagatttgtcatactcctgttgtttttactttgtattttccttttaaaaatatgtacctgatgtctgtcaaatttctgcagaaatgcaacttctaatagagtaatgtttgtctagtgtcttaaaatgatagccaacatcaatggaacagacaaaaatcaaacttgatgacatccagacaaacaaagcctgagagcttctccttatggccttcttgttgctcaaatgtggctaaaatggcttgatactgacttccagctgataatcacctgcccctgatgttgtataagaatatctatccaggacaggtccatcctagcacccagggatattcaaaacctgaatacaggctgatcaatctttctccaaagaaagatcttgattaaaagggggaaacgtgaaagttgcagatatgaggataaagtcagttctgtcagactcaaatttgagtcagggaagcatgaaggggaagggctcatgcttgcatatccgagataaggctatctcaaggactttctaaaataactccacaagaaattccttcacagctttcacatatctcattcttttcatgacttaacgttctgcacatatgcatacatttctaggaccaggtttatcattagacattctttagaactgtagcaattcagataagatgctcttgaaagaacccttgcctagtaatggcatctccaccaatgaactgacgctgactctggctttgagcttctggaaaaaatgaactctttccaagcagcttacatgagcttatcctttttgtcaataaaagcttcctcttaccatctcctctttgggtgtatctgtggctttactatagctgtgctatggtgagattacattatagtaaggttatattatagtctgggcagattataatatagtataatttgtgcccagattatagttctttttacttactcttggaaaaatacattaaattaggagataattttctctgatgtcttttttagcttgatgccatcagcatgcagacatcctctctagtatctcctgtcttgaaaaaggaaaggaggaaaacctcctttgatcttaggtccctcttcacccctgtcctatttaaatatttgaggaagttatttgttgtcccatgtctgctttctttctttctttttttttttttttttttgagacagagtcttgctctgtcacccaggctggagtgcagtggcacgatattggctcactgcaacctctgcctcccgggttcaagcgattctccagcctcagcctccctagtagttgagactacagttgtgcgccactggctaattttgtatttttagtagagatggggtttcaccatgttggccaggctggtctcaaactcctgacctcaggtgatccgcccgcctcggcctcccaaagtgctgggattacaggcctgagccaccgcgccaggccctctgctttcttatctattgtcttctcaacctattcaaattggctttcttttcttgtgctctgagaccatgcttgcctaggtcttgagtgacctccacattgtcaaatctcatggtcacttctccatctgagctctcaacagcatttgacccagtggactattctctgcttacaacaccttctgtacttgctcagatttcctctggaatcactagctgttccttcaggtgtcttttaatgggtccttctcatgcccttgactgtaaatcctggaataccccaggccctggcttgggtactttctcttttctaactttgcatgctcccaaggtagcttcctcagctgcagatttacacaaaatctatacattgatttctctctaaattatatttctagcccagatgcttctcctggatacagacacacaaatctaagtgcctgcatcacctctctccttggatatttaaaaaatctcaaatttaagatgttcaaatgtgaactcttaattatctctaccccaaactgtttttctacttgtgatctcttaagcaaaacaaaacaaaccaaagtaaaacaaaaaccaggactcatccttgacatttctttcccttattcccaattcatcagcaagcctttcctcttggttctactttcaaaatacaaccgtttgcttttctccatctctgctactatcaccttggtcctggccatcatttcttgcccccatgattgtagtagcctcctaaccaatttccagaccagctacaattcatttgcccacaatggccaggatactgttttaaaaaatgtatctcgggccagtgcagtggctcacacctgtaatcctttagaactttaggaggccaaacatgtatacatatgtaacaaacctgcacattgtgcacatgtaccctagaacttaaagtataataataataataataataataataataataataacagcaataaaaacagctcatgtgggaaaaaaaaaagaactttaggaggccaaggagggcgaatcacctgaggtcaggagttggagaccagcctggccaacgtggtgaaaccccgtctctactaaacataaaaaaattagctgggcatggtggtgtgtgtctgtaatctcagctactctagaggctgaggtaggagactgtcttgaacccaggaggcagaggttgcagtgagccaagattgcaccactgcactccagcctgggtgacagagcaagactctgtctcaaaataaataaataaataaaaaagtaaaaaataaaaacatgtatctcagaccatgtcattcttctgcttgcatgtcttcagtggcttccagttgaatttaaaataaaacctaagcttcctcttcgggcctgtgaaacctcacttgacttggcctctcccactcctctcctgaggatgtttagccgctttttgctcccttggtattctaagaaaggtcattctatcttggggcctttgtggtagctgttcccttagcctagcatgcttttccccttgatccttgcaaagtagttccttcttgtcattcacatcatagcacagattaaggtctccttttaagagagggcttccctggctattcaattcaaatagacatttaccctttcttgtctgttatccagttgggtggattattttttcctatcacaaatattttaatattttcgatattttgataattgtttttcaatataattgtgttcctttattctatgtgcttttaattaaacattttattttgaggtaattgcagattcacatgcaattataagaaataataccaatctcttgtatcctttattcagtttcccccagtgataacactatgaaaaactattgtacatatcacaactaggatgtttatgttgatacagtcaggatatagaacaggtccactaccacaaagatcccctgtgtcaccctttatagccatacccacttccttcctgcctccattccctccttaacccctggcaactactatttttttcttcatttctataattttgtcattgcaggaatattatataaatggaatcatacagtctgtgaccttttctgaatggcttaaagtgtcagcgtaatactatattcacccaggttgttgtgtatatcaatagtttgttcctttttattgctgagtagtaatccatggtatggatgtatcacagtttgttcaaccattaacatgtggaaggactttgggattgcttccagtttggggttattatgaataaagctgctataaatatttatgcacagattttcctgtgaatgtaagtgtgtgtttctctggcgtaaatgtccaggagtgcaattgttagaatatatatatatatatggggaaaggcatgctaggctaagggaacagcaatcacaaaggccccaagatggaaacacccacccaactggagatatatgtatataaaatctaacattgtactcctggacatttatcccagaggaaaggtactactttgcaggtatcaaggggaaaggcatgctacgctgaatctgtttaggtttttaagaaactatcaacctcttttccagagtggctgtaccatattacattcccaagagttatgtgtgacagtttcaatttctccacatcctctccaccatttattgtcattctttttaattttagcctttctgttagatgtggagggatatgtcattgtggttttaatttgcgtttccctaattgcttgtgatgttgaatagctttgcatatgcttattggctttaagtatctcctcttatggaaaatgtctgttcatatctttagcctgttttctaattgggtttttaaaaaactgttgagttgtgaattctttatatattatagatattagtcctctgttggatatgtgtttgcaaatgttttctaccagtttgtagcttgtcttttcatcctcttgaatcagatcttttacagagcaaaagttttacattttgatgaagtccaatttaagaatttctccacatatggatcatacttttggagtctaagaactcttgcttagtcagagatcatgaagattttctcctatgtctatttctgaaagttatatagttttatgttttacattttagtctgtaatccattttgaattaatttttttaataaagtgtgagacttaggttgttttctttgcctgtggatgtctacttactccagtaccacgtgttgcaaaggctatccctcctccgttgaattgcttttgcatctttgtcaaaatcaactgagcatatttgtgtgggtctactcatgccttgcctattctgttccattgacctgtatatctgtcccttggccagtactatccagtcttgatgactgtagctatattctaagtcttgtatcaggtagactgacttgtcccacattattctttttcagaattgttttagctattctagttattttgtcttttcgtataaattttagaatactcttgtctatataaaaaaatcttgctggagttttgataggaattgcgttaaacctgtatatccatttggaaagcattgatgaacattgatatgtttcctgttgtaagtcttctaatcaatggatatggtgtatctctgtgtgtattttgctctttgatttctctcatcagcattttgtagttgtcagcacatagatcgtgtgcatgttttattaaatttgtagctaagtattcatgccttttttttagtgattgtaaaaggtattgtattttcttttctttttttattttatttttttgagacggagtctctctctgtcacccaggctagagtgcagtggcacaatcttggctcactgcaagctctgcctcccgggttgacgccattctcctgcctcagcctcccgagtagctgggactacaggtgcccgccaccacgcccagctaattttctgttatatttttagtagagacagggtttcaccatgttagccaggatggtctcgatctcctgaccttgtgatctgcccgccttggcctcccaaagtgctgggattacaggcatgagccactgcgccctgccaggtattgtatattcaatgtaggtgtccatgtatttattgctagtgtatgaagatataattgtttttgtacgtttatcttgtatcctgtgaccttgcagaacttatttattagttctaggagtttttgtttttgttttttagattccttgggattttctatgtaaacaattatgtcatctgtgaatagggacacttttatttcttcctttccaatctgtaggctatttattttcttgccttatttcactgtctagaacttccagcattatttgaataagagtagtgagagttgacatccttgccttgttccccatcttgggaggaaattattcaatctttcactattaagtgtagtgttcactgtaggatttttgtagatgctcttaaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtaccttaataaaattaactgggaaatgttctttcctgttctgttttctgaaggagattgtgtagaattggtattaattctttagacaattcagagaattttccagtaaaaccatctaggcctggtgatttctcatttgggaaatttcaaattacacgtttaatgtccttaatagtgatatagtgttattcaaattatctgttttttatcgagtgagttttattagtttgtgtttttcaaggaattggttcatttcaattaagtgatcagttttaggcatgagagttatttatagtattcccttattattgttttgttgtctgcagggctatagtaatatctcatctttcattcctgataatggtaatttttgtcttctctttttctttttcagtcctggtaaaggtttgtcagttttattgatcttttcaaagaactagccctttgttttattttctcaattgttttgttcttttcaatttcgttgatttctgcccttatccttattattttcttccttctgcttccttagtttatttgcatattttccttccacaccaggttcttgagggaaatgagattattgatttgagaccttttctgtcttctaaggtacaaagttagtgctatattctttccttttatctcacttcagttgtgcctcactaattgtgatatgttgtagtttaattttcattcaattcaatgtatttttgacttcccttcagactttttctttgatccatgtatcatttagaagtttgtttttttagtttccaagtgtttgggatttttcttgttattgatttctactttgatttcattgtcattatagaacactttctgtatgatttcagttcttttaaatttgttgaggtttatctgatggctcaggatatggtctatcttggtatatgttctgtgggtacattaaaacgatgtgtatctgctgttgttgagtggagtgttccaaataaattatctaaatattgattagctctttttggttgatagtgttactgagttcttctatatccttactgattttctgtctagttctattaattgttgagataagtctccaactataattatggatttgtctcccttctttcattgctaccagttttgctttacataatttgcagctctgctgtttggtgcctacacatttaggattgctatgtctacttggtgcactcactcttttactatcatataatgttcctgtctctgataattttctttcctctgaagtctactttatctgatattaatatagccagtcctactttctttttcttttctcctgttttctttggattaatgctcgcataatatatacattttttgactttcaacctgcctatattgctatatttgaagttttttgtttatttgtttttttgagatggagtctcactctgtcacccaggctggagcacagcggcgtgatctcagctcactgcaacctctgcctcctgggttcaagtgattctcctgcctcagcctcccaagtagctgggattacaggcatgcgccaccacgtctggctaatttttgtatttttagtagagatagggttttgccacgttggccaggggttggtctccaactcctgacctcaagttatctgcccaccttggcctctcaaagtgctgggattacagacatgagccactgagcctggcctgaagtttgttttttatagacagcatatagttaggttatgctttttaatctactctacctgtcttccttttaactggtgcatgtagaccacttacatttaatgtaattacttatatgttagcgctaaaggctgccattttattttgggggtatttgtttgttactctgtttttaatttattttcttttctttcctgtattcctgtgtgttaggtgaaattttttagtattccattttggtttatatagtgtttttgagtacacctctttgtactgcagttgtcgtggctgttcacatgtgtgtgtatacatacacacacacgttatcaaagtctactgatgtcatcattttaccagttcaagtgaagtgtagaaaactaacctccctttgtcttccattggccttccctatttataatataatttcattaaatatttcttctatatacatttagaaacacattagacagtattatagttgggctttaaccatcaaatatagtttagaatacttatggaaaggagtctattatgtttacccatatttttgcttatcatgtacttttttcttttctgatgttccaagattctgttttttattgtttcttttagtttagagaactttctttagcccttcttttagggttggtctgctggtaacaaattctcttagttttccttcatctgaggatatcttgatttctccttcatttctgaggatatttactttggatataagattctgggttgatggttcttttctttaagcaactgaaaaatattctgccactttctcctggcttttgtaaggttaaattaaataagcaggaggttattaccttgaggctgttttcattctttgagtttctacctaatgaaccacaaccaaacagtatgtaaacaaattaaaagctaacttagaactataacaaacagccaagtttcagccagtcacaggcagctagctgatcagactatgcccaaataaggcaaatacctcatcataccaggctttaataaagcagatgcctagctgtagccaatccagtgatttcatgactttgcttctgtgtctggcctataaaagttcacttctcatactaccggacacaggtctctgaacctcttctggttctgagtgctgcctgattcatgaattgccctttgctcaaataaacttgattaaatttgtctacagtgtttcatttaacagtgatttctggtgagaaatctgctgtaattcaaattgtttttctctataggttaagtgtcatttctctcactggtttcaagatattttttctttgtctttagattttagaagcttgactatgatgtgtcttggtgtggatttcttttcttttcttttttttttgagacagagtctcgctcttgtcactcaggctggagtgcagtggtgccatctcagctcactgcaacctctgcctctcaggttcaagtgattctcctgcctcagcctcctgagtagctgggattacaggtgcccaccaccacacctggctaatttttgtacttttagtagagatggggtttcgccatgttggccaggctcatctcgaactcctgacctcaggtgatccgcctgcctcagcctcccaaagtgctgggattacaggcgtgagccactgtgcccggctggatttcttgctttatcctgtttggcatttacttagcttcttggatctgtaggctgtcttttgccaaatttggaaagttttcaaccactgtttctttgagtgctttaccagtcctgccttcttttcccttctcttattggaacgctgatgacatgaatgttaggtcctttgttatggtccctcatgtccctgcagctttgttctttgtcttatttttttcctgcagtttattttctctctgttgttcagattgggtaattttcattgttctatcttccagttcacattttttttctctgtttctgcattctgtgggtgagatataggctaatttttaatttcagttattttatttttcagttctaaaatttccatttagctcttcttcatatgttccatttctttgctaagactttctatttttcactgcttctagcatcttcacagtggcttcttggcttctttagaatctttgtcagataattttaatggttctgtgatcttggtgttggcatctactgattgtcttttctcattcaactagaaatcttcctgggtcttggcatgattattgttttattaaaatctgggcatttggggctatgatattatgagactctggatcttaattacattgtctggttttgcttgttttctttgacattgctctggtaggggacatggggggcactgccttgttacttccaggtgggggaagtctcctctcagacttcactgacactcaaggtggggtctcattattgctgagggggagcgagagttccggccattaggcctccactgataacaaagcactcctacccttctctggttgggaggggtatgagtgccttgttactgctctgcacttggcctcaactgacaccatggcgggggcagcctcattaccaccaggtagttctgactctccactaggcatcctctgacatcaccccagtggggaggagcaagggcacctcatttctgctgatggaggcgaaagttcaggctccccacatgctgtccactaccaccaaaggtgggtgggggggtgggtgggtgttgttactgccttatgggtctacttggccttctctgacactgccccaggggtgaggaggggagagggctattggttacctcatttcagcctggcaagggtagaagtctaggcccccattcatcctttgctggtgtggataagggtacggccacattttgttttctctgtggtctgtggctggagtagagcagttattgtctaaaagttttctttcttccttggctgccccttgcttggtcccttggctagagagagcagacatttgcttggtcccttggctagagagagcagacatttgttggggcttttttttttttctgagacagagtctcgctctgtcgcccaggttggagtgcagtggcacgatcttggctcaccacaagctccgccttctgggttcacgccattctcctgcctcagcctcccgagtagctgggacgacaggcacccgccaccacgtccggctaattttttgtatttttagtagagacggggtttcaccgtgttagccaggatggtctcgatctcctgacctcgtgatctgcccgcctgggcctcccaaagtgctgggattacagacgtgagccaccgcgcccggcctgttggggcttttttttttttttatgtccatgcgcatttccgtgttgctggcttcttcagctccaaatcttggacacgtgagggaaaaagaaaactgagagaacccatgaccttgtcctttcttgggtcccagggtcccaagctggtgtgccttcttctctccacctttcagagtcttcttatgtttgtgttctatataatgcccggggttttaaattgtagttagtgtgaggaatagagaaaagtatatctaccccatcatccctgaagcagaagtcctctgtgctacccaattttaaatcccttcttagcggatgttactgtctgataatctcttgtcctgtttatccctatggtatcccaagtccctcaaacactgcctggcacatagtagttgtgtagtaattatatgctaaatgtcgaatgaacattcagcaggtagcgatgatggtgaattggggcctgaatgtcctgcttctgtttaccttcagcctgttctttgcctagatcctcttgatttttttggagggaggatgctaaaaatccagattttatatgaaatgtcctacttttgaaatattggcaattaatttaattttttaaaaagctgtgcaggccaaagaaatgtgtgtgattaattattatgatccactgccaaatggctggcactttttttttttcagagtcttaggtaagcgtatattgcttggatagttcatctgcaggttgcctttttctcagtttttgaatagtggaaggatgttacctgctcacccatagcttggccagtatttgctcaggagctgcatatggtctctgtagagataactcctggctttttgtctgaggatgttcctgtaaaccttattgggaggcagattgggtagtaatgaactgagcgcttgcccatgtgctgttgtgttaatccgttgaaggagcttggctggcagaatgtgagagctctggcatgatcggggataaggacagaaagctgtcaagtcatgatacagatttgacgatgctgggtgggcagagcagcagaaggcaggctttgaaatgggtgggcagcctcacaagtgggctgagcaaaggctggcaagaaatgaggtggagggagtgctttgcttgtagtgacctatttaggaatcttttgagaacaggatgcaagaataggtattctctcgaatgttataaggcagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcggggtgttgcgtgcctgtaatcccagctactcgggaggccgagacaggagaatcgtttgaacctgggagacaaagatttcagtgagccaagatcacgccactgtactccagcctgggtgaccgagtgagcttctgtctcaataaataaatcaataaataaaataaaataaaaaataaaaagttaactagcattcctgaattttacccatcctggatctctgctattcacattggtgtcaccaagtgcattttccaagaaaagacagtcattgcctaaaacaaattgtcacctgttgtattgaaattattttggttacttcctgtgcctgtctaccagatactgcttatacaagtcttgaggaatgcttgctgagtgaatgaatgcttgcattcttttctcatgacttcgcacttacagcgcacagaaatctgaggtctgtagactcctggttgctgaagagttgggatgttgcaccaaaattaaaattttctttattgtattagtctttgactttaactctggcatctactttgtttggagctttgtcttttataaataaataattaggagtaaggatttctaaacattttatcttcatatccaggacaaatgttttgcagttagttaatcaaccattacgtgagtattgatcataatactaattagatttattttgcagatgtggtggatgctatacaaagtgttttagtggaaaggtctcatttaatcctcataactatcaaaaaatagtataaacagtcaaatagtatgtcaaatagtataactagcaaaaagtagattaaaatagtattatttttatcctccttctacgaaggagggaattgaggcttggcaaggtcaagtaaaatttgctgaagtttatacagttggaaagtgatcttcccaggactcaagagcaggcttgtgtgattccaaggcaagtacagtacagtatttgttaccatcgcatgagataaatatttgtgtttgtatttgtcaccattgcatgaaataaatctgttgctaattctctaaccttttctccatgattctgaatccttatataaatttgaggtgctttcatcattcattggagccagatgtcacctgtttacactctgtattacatagaatattctaaaacaggggttggcaaacatttggcctgtgggccagatatggcccactgcctgttttattgtacagcttgtgagctaagaatggtttttataatttcttctaatggttgaaaaaaatcaaaagaataaaaatatttaaaacatgtgataattacatgaaattcagatttcagtgttcatacataaagttctattggaacacagccatgctcatttacctacttgttgtctctggctgcttttgtattacaagggcagagttgagtagttgtaacaagagactgcatggagggcaaagcctgaaatactactatgtggtccctacaaagaagtttgccaacagtttttctggactataagtctgggcaattgaagtatggcggtatgcatgtttctgaagccctggatagaacactagaagcgttttgtctgaatatgcagtttggttgtgcatttttggaggatccccaatgctcaacagttctttttcatcctggtgacctggggagggcctcactctggaatacattcttactttgtagttcaggagctacaagtaccaaaaagtcacctctgctaatgccttacttggccatcacacaccaaactcttctatccagatattatagtactggggaagaatgactgtggtatgtttgcttggatggggactctcatttacttggagggaggaactcaagaagcatttttgggttgcaggttgtctggcattttgctgtgcatttcattgtaatttctcaccagggaaacactgcttgctctcctggctgggtttacttcatttctatcatcttttctttcttgttttaataattccaacttcatcttgccttctcctttgcttcattttgaaagagtcccagtttgcttttcttgccaattctctacttacttttcccagagctcaaaaattattcttgggggtgatgtcattttcatgtttatctttcttctctcacatgacttaatcaaataagtatgtagattataatttgtgagctgtgttctgagggaattaattgatcatcatcatattcttttaaaaggactgtggccagttttagcctcggttaacttcagtcagtttgtacaatagtaatggaatgttttggcgtctattggagcaggcgtggaccatatatgttctataggcttttcagaaattctatgcagaaattatgtgaaccagatggtacccttttgatttgccagacatgcatacttaaagaaatgtggggcatttattctccttaggagacttagagggggttctttgggaatgtaaatcagccaaaattgtcctaattgaaaaattctttggagtttgtcatcaaaataaggagtgtactatcagaagaccgcatagattttgcgggaacaaatattactggatttatttgatttacttctctgagaatgaaaagccccatagacttaggtaaaagaggatataatccatgagatgcttttattttgatagggccatggatttgctcacttaggcctctttggggacactttcagcagtgagagtatgtggatgtgaggtgggtgagggagatggcatgggtcccagggaatgaacagacagtgagggccagttcattaaaccgaaagctgaagggacagggtctagtcattctgagaagaccagactttaggggaacttgcagatcattgcaggggcttaacctacgggagggcaactgttagatttcctctgagcaggtagaaggtgtacatgagtcatagttacatctaagcacagagatttgggattcagcaaggattgcagaggaggagatagtgtctttcttcaggtaatatgaagagcacagtggaactggaagccccagccagatagggagagctgagtctggttggctgtctgcactggcacttgctggggactttggggaaatgtctttcagtgcttcagtttccttatctgcaaattggagttaatacctcaaagggctgatgggtttgtgccgcttacaaattatttggctcaattctaacttgtaatgttgtgctgaagcttagaaattatgtatctcaagtgctttatatatgatatatggtttaattaatgggagctttagtatagtaatcatttagtatactggttaagagttgagttcagaatcagagagacctggctggagtcgcagctcagccattttggtagctgtgtgatggtgaacgagtcacatatcctatgtaagcctcactctcctcttccgtatactagggtaaagagcagctccaacacggtggactcaactttggggattaaatgagctaatgcacatgaggtgctcagcacagggcttggcccataataaacgtgtaataaatgctagctgataactttctccactgacctcctgcctggaacagaaaatgaaattctgcttcttaaaaccaaatgttataagcttcatccttataaaccaactgcctttagaaatgtcctctttctactcttctctgggttcctggggagcagaacgcctgcttgggtgatgacttatgtctctcaaatcctctctacccctccatgatatcacacatttccgtcgtacggcatgtactaaggtctgcacttaatttatgatgtaagggccaggtgcgtattttcagccttcaaaggctgagtatatttgggattgactctgaagggggaatcccctgttgtttcattcatacagtaggtatagcctgatggttagagtgtgggttagtatatctgggctgcgtagcttgctttcttggttggcactccactgtaagcagacctcgatttgtgtagaggtagagcgtgtgcatgtgtgtgtgtgtgtgtgtggtgttgatgttgttgttcttgcagtgatcccgggaaaactagctggtgagtagggagagtgacggggaggagatggaagccaatcaaggtgcactattaatcaagttagttaccatggatggtaactggagctcattcttcctagggaactctcacagacagcatagaagccacctgagagttatcccagcaaaggcaggaagctgggggatttatctaccaactgccctgcccatcattggctgaggactgtttctgggacgttaagtccctggcacttccaatttgcctggcacatgggctaatgttcctttggttgggggtaaaaaggcctccagactgaaggttgcaggtgtttgtggtaacagacttgatcttgtagaattgagtcctcggggccatcagtggggcactgacagcatctgctctcctgtctaaggtggaaggctgtctctgccacctaccagctctgtgatcttggccacactacttattatgcctgagtttcctcatctgtaaaatgaagataataataatacctccttcccagacttgtgatgggaatgaattgaactgatatgtgtaaggcacttggtagaatgcttgccatgtcgtaattgctaaataaatgctaacttttattattttgtgattattcattgagtttcttcaggttctttttcagtgtaataaaattcaccatgtttactgtgacataagatgaagattttttggatggaaactaattagttgtttctttgggcatcagattatttccccaatttttatttatttgaaaactgttacaacaaaaacgcaatctgttttagggttaaaaaaatcctctttaactctatcacccttcaattattacttttatctttttgttcctttggagtctgttgatataaattcatatttctacactgttataataaataatggcaaaactcagtttttatcactgtttgttctaaaaataaaatagcaaccctgtacccagcatactttacaggttttttaaagttctcacagtttatgaagaagatgccgccatcccaatttcacagatgagaaaactgaggcatgcagacattatgcaactcttttcaaatcacacagttgttaccttgtggggccagcatgagcctgggaggattgcaaggctcgggcctcccctctgctctgtgtctctcacggtggctgaggtagaatacagcttggaagttcagccagcccttagtatccatgggttccacatttgtggagtcaaccaaaagaaggtcagaaaaatttgagaaaaacaccaaaacatctggattgaacatgtgcagactttttcttgtcatcattccctaaacaatacagaataacaactatttatttagcatttacattatattagctattataagtaatctggagacaatttaaagtgctgtatatgcaaaaatgtgcatagattatatgcaaatatgactccattttacatcagaggcttgaccattcaaggatttgtgtatcccatgggagtcctggaaccattcccccatggataccgaggggtagctgtacatttattggtgcctgccttcttgcctggtgcctgtttgttctttttggattaagagaaataattcctggctgtgcacggtggctcacacctgtaatcccagcactttgggaggccgaggcgggcggatcacctgaggttaggagttcgagaccaggctggccaacatggcgaaacttcctctctactgaaaatacaaaaattagcgggcgtggtggcagccacctatattcccagctagtcgggaggctgaagcaggagaatcgcttgaacccgggaggcggaggtttctgtgagccgagatcctgccactgcactccagcctgggggatagagagacattctgtctcaaaaaaaaaaaaaaaaaagagaaataattcctgtcacagggagcggaaacatgctgaaataattatttgctgaaattgttttccaacagatggctttaggaatcaggagatttgacactaggacgttaggtgggcaatggatttctagtaatttgtcagctttgttttattgaggtggagctgcatttaaattgctacttctccctgctggtttggtttggttctcctcagaaatggcttactttatttgtacttgacttgagttacattaaagcaggcaaaaatatttcttaagagctgaaatttcaggttggcaaaaggaaacaatgcaatctttaatcatatatctgaaagagcacagtggtgcattatgatggcagaacttcattccctaaccctgtacaaaggtttttagagactaaaggattgatcgtttttttcccctgacaaaacacctcttttgacatgtgcagagaaatatgtaatttgggttgcattgaaagaaagctactcttgctatttctctctccaagaggctgtgctcttggagttaatattttctactggagacagttctacttgaaaggcaaatattacaaaaaaccactagagaggcattgaaatctgttgtgggaaggagtcattttaaattttcttattaaaagaagatggcactaaagaggggggagtcatttccaatttattacttaacagaaagatgagcaatttgtcctctcagcaatagtgttctgtcagataacctgtttgccatttccttgccaacactgggtcttgccattcatttgaaatgtttgctcttgtgatctattaaaaaatttgtatatattgattttacatatgtgctgatcatttgcatttcttttgtgaattgccttttgatattttccatttttaaattgtcattttcaaatttacctttatatatgaaatatattaatccatcatcatatatcttgtaatggtttatttagctgatcctttgtggttgttgcaagcttttttgtgtattgttttacagtttgcagtttttgtcacaaattaaatccattttttgggatataaagtaggctttactttttatatattctgttcttttctataccggtggaaatcttgttattaatgtatactgcctccttagggtttgttttccaaatctcttttctttctacaagcatattagtctgttgagccttcttaagtttttttttttttgattcaaagtgtcgctcttgttgcccaggctggagtgcaatggcgtgatctcggctcactgcagcctccacctcccaggttcaagcgattctcctgcctcagcctccggagtagctgggattacaggcgcgcaccaccacacccggctaactttttgtatttttagtagaggcgagttttcatcatggccagggtggtcttgaactcctaacctcaggtgatccacccacctcagcttcccagagtgctggaattacaagcatgaggcaccgcgctcggctgagccttcttaagttttgagagaattttcttaagtttgttttctaagtctctcatttggtttcctttgatacgcaagctagtttttctatgctataccatttttaatgtgaacagttccgttctaggaatagaaatcttgatctcaatttgtccttcttccagggggcaatgccatcaagaatccaacctggaaatcagaatcagtgcactgttttgacttttccttcccttgccttctgtgagtttgtttcttatggtcatacttactttgatttctccaattggttctcttattttaaatgactgagtttcttcatatgttggattattttctcctatgctcttcaaagaaagtggctctagtgtgtctagtttcagcaggtgagatatagtctgttgtcagcccagacagggtgagaagggagagcttcagattgatagtttagctttctgaaaggaaggttgcaaatggagggccttgctctagaccagtgcggcccagtgcaaactttctgtgctgatggaaatgttcttggatctgagctgcctggtatgatagccactcaccatgcatgactactgagcatttgaaatgtggctagtgcaagtgagatggatttctaaacttttatttacttttaattaatttttattaattaattaaaacataaatttaaatgaccacatgtggccagtggctatgtattagatagcacggtcatcatgaggacggcttcctgtgtgatttgtttactgttgtgttcccagccccagtacttgtcacacagtagacactcaatattcatagaaattaatggatgcagcaaggggaaatctctggtagggcttctttccttgctatgccaagagttccttttctttctgtgggtctgcccaaagttagagaagtcgcattaccctcatcagtaactaccacaagtgctgttggtaggggcatctgtaggattcccatccccatggccctttttatgtcctactgtgtgtgccagtctgaccagtgagatcaatccatccttgccttaggaattcctaagaatttcagaaatttctcaaagctgctgccaggaagttgggagttgtcctagtttgtaaagctgatctagatacttctcagttttatagtcctatggccattccagggagaatgttggtgctagagagaaaagaactgagatctgtgttttgaatcaagagcctattgtcatctttctgtgttttaatggcttactatatcttgatgcaaaagcttcagtgtttacgaggctccactactgattgtatctttcagcaatctcaaatgaccctctttaatcccattttctgccttcttcttatactcagaatgatacaaatattacccccaatttaattttttcctcacatttgccctcatcttttggtgtaatactatggtgttactttaaagggtttttaagaagcaggtaatttatgtttgaaccaattttgattgtctttgcctattatttattgaggaaatcgtactattgacacagtggtatgtctggtcatctgccatttcgttttccttgttttttgctttcagtcctgtctttacattatcattacatttacttttatcttgtacttttgtttggatcatagttatgccatttctaattctagtagtggatcctattaagtttttaaaaaatccatattaaatctatatttatgaaattgctgaagtcagtaaaaatagttttttttttcactctccctgatagacaatcccacatttctttattttggttgtttttttgtatctcttttcttttcttctatttcctgagacatttggcaatctaatctagaactattcaagtcagcatttcacaaataacctcagtgattttcttttgtgtctctcttcataatcctgttatgaattatgcatgcatttatattaaacttagttgatgctcactttgccattttgagttcttaggttttccagctctctctgacatgaagcacattttcaaatacgttcttcaagaagcatacaccatatgttttctgagactttgcatatttaaaacattttttttggttgccttctgttgcgaacaacaatgtgtcttaatttagtagttttaaagtcacaagtgtttaaatattaaaatgtagatattgatgcattatcttccaaaacctcctgttgggggtaaatattgaggccatcctgatttgtattcccttgcagataatctctctgtctcctattttctcacctttgaattctgatgactctttatgtgtccttgagactaaaaaatgtcaccagaacatgtctatcagtgaatctctttccattaattttgcttaatatatgatgaaccatgcaaactgaaatctgttttcaactgaggaaagtgtttttttctggtaagtgcttatttattgtttggatactatttgtgtgggttttattttgggatgaaatagttttacatgggttggatgtttcttctgtgttccttcatatattaatgtaggtgcctcaacaagtctggggaagaataatgaaaaagtgttgtgttctttgcgatgatttttgtttttaggtaattttttgctccatttttgaagtatttctcctctttttccattggctgcattttttagcattgtaaagtgtgtgaagtttatttattcatttatttttttgaggtggggtcttgctctgttgcccaggctagagtacagcagcatgatcatggctccctgcagcatccaccttccaggctcaagcaatcctcctgcctcagcctcccaagtcgctggaactacaggcgtatgccaccacacctagctagtttggtttttgttggcattttttttttatagagtcagggtctccctatgttgtccaggctggtctcgaactcctgggctcaagccatcctcccgccttggcctcccagagtgctgagattacaggcatgagccaccatgcctggccggaagtttactttttactgcctaccatgtggatttgtttttttaaatttctattatgaggaattttatacatacagaaaactaaagagaaaaatactatgaatacctctaccccatcacatagattaacaggtattaacattttgccatctttggtttatcttgttttattcctgaagcattttaacagaccacgtaacatttcattcccaatacttcagtatgcacatctgaaaaataagggcctttctcttaggcctttctctaaccatgctaccactatcacatctaacaatgattttttatgtcctccaatgcccagcctatattcaaatttctctaatattctccaaatgtcttttatggccagcctgtatgaatctggatctaaccaaagaccatacattgtatttgatagttatgtctcttatactgcttttttttaaattcaaatttacataacataaagttagccattttaagatgaataattcagtggcatttagtagtcacagtgttgtacaatgatcatctctatctagttccaaaacattttcatcaccccaaagtaaaacctcataccctttaagcagttactcctcatttcccaccccacccatctcctgggaatcactaattatcctctgcctctgtggatttacttattctggatattttatatgaatggaattgtacaatatgtgaccttttgtgttttgcttcttttacttagcacagtgtttttgatattcatccatattgtagcatgtatcagtactttattccttttcatggctgtataatattccattgtataaatataccataatttgtctattcatttatcctttgtggacatttgggtttttctcccttttggttattgggaatagtgttgcaatgaatacttaccctagtcagctcagactgctataacaaaatactggaaactgggtggcttaaataacagatgtttatttttcagttatggaggctgggaagtccaagatcaaggcactggaaaatttggctcttggaaagggcccgcttcctggcttgcagatggctaccttctccctgtgtcttcacatggcagagagagagagagagagcactctggcctctcttcctcttctttataagcacaccggccccatcatggggtccctacacttgtccctcttctaaacctgataacctccccaaagccctgcttccaaatacaaccacattaggagttagagcttcaacaaatgaatttgggaggacataaacattcagtccatacaatactcatgtgcaagtatttgcatcatattttcaattatttggggtatataccctgagtggaattgctgggttattcttaaatgttttaatcttgaagaatttttaaccggtttacctgttttttttttttttttatctttcttgttccttcttgttcttttcctgcaatgacatcaatttgataacatgactagttcagtcgtcccatcttttggcttggcctgattgtttcctcttgttcttcttcagtatgttcctctgtgccttgcatgtcttataatttgggtaccatgtttttattttctctgcagtctcttttttccgtctgtttactgtttgatatatttgcctcttctgtttggtatgtggactattttgggggaatgtgcccttattttctgttgtgaacccaaagaagtttctatactttcctgcaataaatctatgtgcaagaatgtttttgctcttttttttgaggaacggtttctgtcctcttgtgcttcaaattctggtcataggcatcagactgttgtgtttctccttccttatctgtgaatagacctagtgttggcacacagatgtgatacactggccatttgcagtgtaccactgaccctggcacaatgccttctcatatctgaggccaggggctgagctggtggcaccaccaatgggacattcctagtctgtggccccatcccaggaagctctttttggctgacatagtttttctcttctctcactatccatttttttttctttctttttttaattttcttttctttttcttttctttttttttttttcctgagacggagtcttgctctgtcgcctggctggagtgcagtggcgcgatctcagctcactgcaaccttcgcctcctgggttcaagtgattcccctgcctcagcctcccgagtagctgggattacaggcacatgccaccaagcccgtctaatttttttttgtattttagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggtgaggaggttgcatgcctcagaatgcagttagcctgggcatctgtgcaccaggctgagttcttgcctaggagctgcagatgtgtgatgaatgcagaactaaagttattgaggagaccaagagacttgacctgggagtgcttatgtggtttggatgggattccttgaggcttttgtggaggagcagtccgtggagtcagggtgtccgtgggtcactgttagcccacatggtgctctttgtatgagttagaaaaatacgcctcttcctcgacacactttactttcatgcgggggaaaactctcctatcctgaattggttagagctggtgatttgacagccgcctgctggaaaattgtatgataagtacacaaatctgcttcaggagggtgtgctcccttccatgtggcacagttgtcaccccctgcccagctgcctctgcagccactttgggttttgtggctgatgttcactagccactgactatacatctgaatctcttcctgtcagtagaagatccttctgatttgggcatatggtcaactttttatttttcataactcttgctacccctttcctccatttttattagttttcatggggacttaagtgagcatccaggcaccgttgctgatctgtctccctgacccagaagaccatgttggcttttggacaaagatcctggatagttctgaagctatgatgctgtgcatcagggttgaatgggggtcctgagagtccagcattgcttgtgctagcagctcatagcagcttaacttgtgtagcagaatgggtgccttgtaatagatagccatctgcttttcagtttatggaaggcttcgtttcttctgacggcattctgacgggcaggtgttacatcttttgtgactcccaggttatgaggctggttcttgggtttgactctgggaatcatgctcattgatctgcttttcctaatcatgtcagtgaatacctacacgtgaagaaaactcaagctgcaccataaagctaaaggaagaaggtaaaaaccacctcaaatttccgtgatacaggaaaaactgctgtgaccctccacttctccatcctggtcccatttcctgtttccaccctcatccagtttgcttttccagaatctttactgcttcctttgatgggggtaacgactctccctaaccaccccacctcccgtgggaactgttaccccatccatagccagcatttgacagcccaagggcaggtttatgtatttgcaaacgacattattctcctataactaaaaatgtaaagatcctttcgtattaaatagtccagtgtccctagggcacagtgcttttggatttcagcctgcttctgctttgtgatcttgggaaagtcactaacccctctgggcctctatctctatttaaaaggaagaggctgaaccaaaatgccctttccaggtgaaagcaagtggggaagttagacctatttagggaatagagaacagcctgtgggacaggtttgtgcttattgttggtgcagtttagtaggaattgtcagaagccgatagatagatagatagatagatagatagatagatagatagatagatagataatagatagatagataatagatagatgattgatagatgatagatagatgacagatagatgatagattataaattgatgtttgatagatcaatagatagataaaagggaaccaaatactgtctctgtggcctgggcatttttgccaggcagggggaatcacatcgttggtgacagagttgtatggcccacagaggccagctaagagattgggagaaggttgttgaccttgtgtgggaaccaacctcagggggatggatgaggttggggccccttaggggtctccgctcttggcgtctggactccccttctctgtgggtctaagctggcttctttctgctgtgggattgtgttaacactgcccctttagtgattttgcgttttttttttttttttttccgctgaccctcattagcagaggttttgctcttacacactgcattgtcccagtgacttcttatatgccagtcactggtgggtaaatgccagagggacactgagggctcatcaggaggactcagcctcctctcagagaggaagccaaggtggccagattacaatttgttttttctggtaaatgtcatgggtaggaaatgttatttgtgagtctgaaatatccaccaagggcagagggtgctctgaagacaaacaggaattgagtgctcattttcttggccctgaagtgatgtgttgcctccgtgatgtcacagttggcccccctacaacctagttcagcctggcacagtatatgacggtggtcactggctttctatctgggcaggatagcacctgcacatcagggaaaacagaccaagctctcacaagggcaatatcatcctttggaatttgttcacttttaattacaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacaggtaataaatgggaaaatgttaagggggagtggttggggaagaacagtaaacttggaaaagccattctcatcagcacagaagcactgaaagaaggtacagatcttcatggtgaaaagtgggaagccttgtattagcaaggagtgatgattgacaaagacctaaggtctaatgtctaatgtgtgctggggagagtccgagaatcctgtgggtacagagaaaagtaagacattagaagtccttatgtgtgttttggagacagagtccctaagctcacctggtcagtaagtgtctcttgcatgagtgaattggacagtgcggactccattctgcaaaaagcttgattggaggcaagtggaaaggaccttggaaaattaaccaaaatgcaatgaagctctttcctaaataccaatggctaaagaacttcaacatgtcagtgttgtatgaaatacttcattggactgaattgtcctctgaatttaatgttagcattccctcaagagtcttggctttctttttttgcctgcactgtctgcattacagtgcagtaaggcagacttttcttgtgaagtggtatggataagatttagaggatctgaacacctctctgctttggaattcgtggtagctaaagtgtaaatagattcacacatctgacattcaaagtcagaaattcacgtggtcttgcactgttctggtgtgcaagttggtttcagaaggggcttggtgtttgaaaggtgctgtaaggagtggaagaatcgatgccatcttcagatgtttgttccaagtcacaagcaaaccctgcttcaaatctgctggcaaggcctttgagtcacacagagcctgacttgttcactttgtgtttgtccagcttccatggcatgtggaagaagttggtcggcttgggaatatgctgaatcaagcaacataaccaaccaatgagagggggcttaagcttctttcaagccgggcaaacctttagttgttagaagcccatacttcctatgtggtggtataggaaggacacagacttacctgtaggtttcttgccaaaaaatagaattgcgatctgatcaatcttccaactatttatagaaagtacaggccaggcttggtggctcacgcctgtaaccccagcactttgggaggcctaggccggcagatcacgaggtcaggagatcaagaccatcctggccaacatggtgaaaccccgtctctactaaaaatacaaaaattagctgggtgtggtggcatgcgcctgtaatcccagctactcgggaggctgaggcaggagaattgcttgaacctgggaatcggaggttgcagtgagccaagatcgccactgtactgcagcctggtgacagagcaagactccctctcaaaaaaaaaaaaaaaaaaaaaaaaggaaggtatggacgataaggggttcatatcaaacaacactatgggaatgaagtccatcggatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtccccaaggttacacatggtaagcggagcagagtgcccgagaattaatggcctagagagttaatgtctctggaagcagtgcttagccaaagatgggtggaaagctggtggacaaataccccagcttccttccctctatcccccagggttgggaaaactctcagtggtgccccacactgttttccagagttgtccagagagactgagcttcatttgcccccagcagtaacgaaccctttgttggtggtcctcccactgtctcactttccggctcccctaccagtttcactggggtcacctcccagttaaaccatttgcactgaaatcattgccccagggtctgtttctgggggaaaccaaagtaggacagggacaaatcaatccatggaacaagtgaaccttatttccatctggattcaaacaacccatctgccaaaaggcatttatgagttaaatgtggaaacatgatcatagatgggatattagatgattttaaataatcgttctttaatttctttaggtttgattgttgtttcttggttatttttttaaaaaagagtgcttatctgctagagatccacattgcagtatttacaaatgagatgatacgatgtctgtggtttgctttaaaataatccagtggtggtggtggaggtggaggggcaccagggaggggatccggggactataaggtgggcaaaactttaataactgttgaagctgggtgatggggacatggcagttcattacagaggttttgtggtgtatttaaaatctttcatagtaaaatgttaaagaaaacaaaaaaaagcacatgtacacctttctggtctccctcctctgaggcaaaattaaatgatcctcttcccagccatgttaccgtgacacatcggctctgtcttggggatcagtggctcagcaagtgagtccttagtgtctcagttcatggccctcctccatgctggtggccttcacctcctccattgcatccatccatcccgtagccagactggagcctttggcatcacccagacctgcttttacctgagttcttaaattccatcctgtgagctcctgccctgagcgattcctctggttctattgcagcaactttccaatctgtaacccgccatgcaatcataacccacgtggtctcgactgttaagtaccagaactgctgggcgggagggagggtgagcctggagacagaggtcaggccaggttgtgggccttctcctgtaaagagtcttcagcaattctagtgggatatccaagaggttgttgtgactttggccttggccaaacaccccaggggtgttataattggggggtgggcagccactgggagaggaagtgccaccatggctgtaagtggaagaatagaaacttcaatcgggagggatccagtacaggaagagttcagttctcagggagagagggttggagaaagcctgagtcgttgttagggcattagccaaatggccaggacttttccagagggaagctgggatataatcaggaaactagggcaggaggctaattctgcatactggatgcatgggccaggttcaggtgggtctcctgcccaaggcttgccacaggtatgccaggctttgggtggcaggaggaatggcagagctcagccactggagggaatgagcctgtgcccatggggctagtttctgatgggctcggtcactggaacaggttgggtgagggtggccatggagaacctgcaggctgaagatcttttatatttggcttatttattgagaggtctcagctctgcacatacataggaattggttttatttttgctaatcactgctttccactgtgctgaagcaagttcttctctccttctgtggagtaggactcttgaggatcctttgaccagggccatatatttcctgtcatggttaagttttaaaacctttttatttctgtatgacttagtccccctttttttttttttgaggtgagtcttgctctgtcacccaggctggagtgcaatggtgtcatcttggctcactgcaacctctgcctcccgggttcaagcgattctcctgcctcaggctcctgagtagctgggacaacaggtgtgtgccaccgtgtccagctaatttttgtacttttagtagagatggggtttcaccatgttggccaggctggtctcgaactcctggcctcaagtgattcgcttgcctccgcctccccagtgtgctgggattacaggtgtgacccaccgcacctggccgctttttgtttttaaaatatcagtttccaacctgattgacagtttgtcctcaacagcatgggcagagatgggatcctggctgctggtagcggaagagggtgctgtggtcaggctctgtgcacctcctccctctcccccttccagatgctccttcccttggtgctgggcacaggaaggacaggtggagaggcttagttctatgtgtcttccacctgcagagggtgtatgggggttcctggtcttgctgtggtccccccggttctgtctgatgctggtgtggcacctgtgtcttcctgtggtctcatctgtggtatataatcccaccctcttttcctggtgctatttcccttacccttgaagctgcctggacaggccatggctcctctcctgctgctctcccaacctgaaccttcttgttgactcagggaaaccactggagtcttctttcataccctctgagggccatagagaatggtattccttcactgaaggcaactctagtctttgcaagtggttttcttggagtccctcggaactggctttgagaaagggaaagcatcctcatcagtttcccatgagaatgtgagggaataagaaaagtagctaataggccagatgtggtggctcatgcctgtaatctcagcattttgggaggctgaggtgggtgaatcacttgaggtcaggagttcaagaccaggctggccaaaatggtaaaaccctgtctctaccaaaaatacaaagaagttagctgggcgtggtgatgcacacctgaagtcctagctacttgggaggctgaggcaggagaattgcttgaacccaggaggcggaggttgcagtgagccaagattgcaccactgcactccagcctgggtgacagactgagactcggtctcaaaagaaaaaaaaatgttgcactaaacatctttttccatgttaaggttgtctgtctgtatttaggaatggactttccttatgatagactccactctgtgatgtgaaatttgtacatcaaaggatttgaacaattctaagtacaaatttttatatgtgtgtgtgtttgtgtgtgtgtatgtgtagtacagttttaattgctcccatgatacatagtcattagagaaaacccttgttaaaaaaaaaaggagcggggaggagaaaggaggcaaagaaacacgtatatggatttgcgtcttccatttgccttgaattaaatttaatgtcattaaaaaacccactggccaggtgcagtagctcatgcctgtaatcccagaactttgggaggccagggcgggaggatcacttgaggccaggagttggagaccagcctggccaacattgcaaaaccccctctactaaaaatacaaaaattagccaggcgtggtggtgcacgtgcctgtagtctcagctactcgggaggctgaggtgggagaattgcttgaacccaggaagtggaggttgcaatgagctgagattgtgccactgcactccagcctgggcaacagagtgagattatgtctcaaaaaaaaaaaaagaaaaaaaaaagaaaaatagctaatacttacatagtgcagttctaagaatgttaaatatttcaattgatttaatccttgtgataaccatttggagtagacattagcctcattttatggactagagtggatatatatagccctacatcacacggtttataagttggcagatccaggacttgaaccttgtctttcgggcttaggtgttacatgtcactcttgtcacgctgaagggtccttcttttcctctctttatattgatttcctctcttatattgactgaatgggaggcaggggagtggtaagggcaggggaccagttttgacacctcttggaaagttgtgctgtagtagctggcatcatggctagaagcttgtcggtgactctgactgtggactattgtgagctttcagtcattagctttggaccttagctgtgattccaggtcaggaggaaagttccactcaacttgctatttctcatctagctcggcagtgttgagaggcctggctcttttcctgaagctattttccccaagctggatatcttaggacttctcttcctttcctgcctgcccagatcccatgcagggcagctccctttctcacagacccctgcaaacccctccctccactatctttcctatgtcttctgccaacctcaggccctggagccctctaacatctgtcttctctgctatacagggtctgccaggaactgctggagaaaatcttgtaattgtgctggtgttacatatttatggcttcagcttcaagataagtcactaatcctttattatgttcttgaatggcttcctcttccactctttgtcatggctcttgaagacccgttacagccccaagaccccgtggtagtagtcctaccttcttgccccttgtcttcacgctctcctttactgacacttaccttgaggttatctaccgggacatctagagcctattgttcgaggaatgcagtcttgcaagcctactctggacccgagcagctgacctcttcttccacgccccccttctcgctatctcttttaccaataaatatggagggctatgtaaagctcagggcccttgtccactagaggcaaggtgccccctgaccccttcttccaaacatatttttttgtctcttatctttattcccacattcatcctcctttgttcagtcccctaaggtctgtgcaggttacaattaagcaagttggcctcttgtttaaatccttcccttgactctctctccccttaggcctcccctgtctcactcttttcttcattgctggacttttagaaagcatatctctacccactgctttcacttcctgatcacgtatcactgtcaaccaatgtaatctactgtcccctccatcatcacacaatggatctacttcagttaagttaccaacatcttcctaaaagatgaatccagcaggcatttgtgtctttatttttgacaactctgctctgttgtggattttgaccatctccttctggaaacatcgtctactatgattcctaccacaccactgctggttaaacttttaactctctgttcactatgttttattttccagcctctctttctctgtccaactttttaaaatcagtgatcacgaggagtttgctcttggtcatctagtcttttcactcagttgatgttttgtgtatgataccatgactctcatgataacccatgtggtcacctgttcataattcctgtcctgacatttctcttgagctttaggcagcctatctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagctcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccatcttcctcactgtggccagagggatcttcctaaaacaggaatggtcaccccctactgaaaatccttcagtggcccttcagtataaacttgtactgcttccatgttgtcaagcccttgtgtctgctggcctagctctagccatctggagctacttggaagtttgcacactatgccctgttgggttatccctttggaccaggtccatgttcttccttctgctgaaataagcttctcctccacctccttctattgtcctcctggtgttttgctttctcctcctttaagattctgttgaagcattacctgctgctgtaaaaattttaggaatttttacccgtttccttcctcttcccccacctgctgaggtgggggatgggttgctttgttctccgtgttcttacagcgttttatacatatcttgcctctcatgatcaggggctctatctttcttacccctaggttttttaatgtctaaggcctggaaaaggaggtttacagttagcagtattttattaaatacttaactcattaaagtcataaatgtaaaactgattctacattaaactttaaaaaataacttacaaattttataaattcatttgtaaatctgatatttatgttaaaatgaaaggcactccagcctgggcgacagagactccatctcaaaaaaaaaaaaaaaagaaaggcacttatctttgaacagtgtttaatttataaatttaaccaattaaatccctcaattaatactatttataaattctgttaatttcccttaaacattttaaagtgtagtcatacgtgtaatcatatgttcaattagtcatccagttctcacagagatccaaatctgatcaaagaaacaaatgtcattcactaaataaatgtttactgagtgcctagcatgtgtggtaactgctccaggcttggagactcagtgattaatagtcaatgaaatgaccactgaatggtaaataccgagaattgtgccaactgtaaacctgagtaaatgattattagtgttttaactagtgtcactgcaacctgagtaaagtatataaaatcctatcagtacacaggaccttagaacaaacaaatacacaacaattacacagtagggcctggccacagaatgaggagatctgaataaaatcctggaagatgacactagaacccaagagcctcgcaactccctgatatttaaaagctgcattatttcaggaaaaggtaccagtctgctgaaaaatggacacatgacactggagaagatcatctgaaagggagagggtcgggaagtcctgttgactgctgatgtggcagctatttgatgataatgaggggctgaacaaatgccagctcagatggaatcattctggaaggtgcactcacattctgagtccaggccctaatctccagtcagtaacatggagcttgactttattgtggttcccagtattttatggggtaaccacagctgacctgaggtggttattgtgctgtccttgattgggcgaactacttggaaatttgagataaggaaataaatccctggtgtcaatgcttctgtattggatataatgatagtaataagatatattgatagtaataagctttgcaggcatttttaggtgtgtgttttgttgctgcctccttttgagcccctcttcccggaccacacttttgctggagttcacagagcaggctggagttcatcaatgaagccctggaccaatgtggccttcaggccccacatgctgagccctatcaagtgccatatctctctccactattggtcttgggtgagatgctgcattgggggcctagaacctggcttctcgagtggctgtccaagggctggagggtgaaacccggaagtgttgggtctttggctcctatggtgaacctcaaccaatgggagaggataggatggcactgggcagatcaatttcccttcctttctcccttccagggactactctgaggtgcagtttcttcttgcagctctttgtgagaaagtccggtgtgctgatggacatggttgcctagtggcctggagtgttttgaaggtggctggtgcagttacaccctttatcccacaatccttggactctttcttggccttgctctctttcctcactcttacctgggctagtaactcgcacaataaattgtcactttaatccttgtctcgggctctgctttctagaagacaggggctacgaaggccctttgaaaagagttataatcatggattttggaatatttcttgtcctctgtgtatccctgaaacttagtactttttggaattggcttatgcttttaatgacctttagaccagaaaatattatatttttaaattgttttcacctgacgtttttagtgttccaaagttgtatgcttatcagaaataagcaagaactctgcaattctttgaaggccaacagcttgttacactgtttatagcataattaacaactttataacatttatgaaagtaaatggattaaatttgtaattattgtctggaaaaactgtatttttacattttatgaaacttaagcgactcaagttatgccatatttcatacataagctgaactttaattttagattcatgattagtacatcataaaagtactttctgtgctaacatttttctcttcctgacttatatatttaaaaaaaattccctttgctaatcatgatcctgtttaatattcttgggaaggttagaggtggaattcagagtgagattattggcatcgcaagaggaacagacactgaaaggtcaatttattcaatttcgtgtttgggtgcaagatctcagttactcgtcctacacatgagaaaacccttcttgcctttaagatttactggcttctggctgggtgcagtggctcacgcctgtaatcccagcactttgggaggcctaggcaggcagatcacctgaggtcaggagttcatgactagcctggccaacatggtgaaaccctgtttctactaaaaatacaaaaattagccaggtgtagaggcccacacctgtaatcccagctacttggaggctgtggcaggagaattgcttgaacccgggaagctgaggttgcagtgagctgacatcatgccaccgcactccagcctgggcgacagagtgagattccgtctcaaaaaaaagaaaagaaaaaaaagacttactggcttctttttagacacagtttgcaggaaaggaagggaacctaataacccattagaaaaataggtgttttataaataatgttaattgcagctatttcacattcagacaggtataaccaagactaagcttcactctaggaataatataaagttttaatcagaagaatagtttcaagttcttagaagaagtggtgtgtctttagatcaagtgacaactatgtgtctaaattatagcctttacccaagggtctacagactttttaggaatgaccttcacctgggtgggatgcattcccctcatcagtgtgtggaaatggacagcggatcagcatcccagagcctaagggtttgccgagttggtgatcaccatcagcagcaccttccttgggtgccccagggcaagtgagtaaccactgccatgtttggtgtaatggtgagtggaggtatcccacccacagtaggagacaggagaggccgaggcctccacacccacgtgtgcatacttcctggattcagcatgtgtctcccaaattacccaggaataggatgtaatgccttgtatctgtgacttttggaggtaccttatatatgcctgtgtgaatgaataaatggatggatatgaataaatgaatgggcctggggtttttgttttgtattgaggcaaagtctcagtctatcacctgggttggagtgcagtgtgccatcatggctcactgtagcctcgaccttctggggctcaagggatcctcctccctcagcctcctgagtagctaggagtacaggcatgctccaccttgcctggctaattaaaaaatacatatattttgttgagggggtttcactatgttgcccaggctgggggctcaaggttttctcatgggtttatttgctaattgtgtttctcctgttatgacttgttcacacccttggcctagccatcctttggagtattagtttttttcttatgaatttggatgagctcccaatatatataccagaggcttatgtgaccagaggcttgaaagaacctaacttctatttcctttaggagcaatggttcagtattcattaattgagtgtttgtagtggcttttaatagaacataattacttttaataatgaaagtccactgtatttatttcacacctcttgatttttctgttcattattttggattgtttttaaataaatcatgtatttcatacatcacttatgttcattgatgaaacattataaaatacaaaaaaagaaaaaaacattataaaatacaaaaaaccaccagcaaaactgttatccacatctcattaccctatattgttactcttaatattggatatatacccaatattattacatttacatatgttcataaaaatgcaaaaatgaaatgtactggcttctaacctgcttttctcacttaatatattgtgatgatttttctatgagaatatggatccacatcataatttttagaagttgtataatatggaaaaactacaatttatttaaagttttctaattgttagatatttaagttgttaccagttttcactaataacaataagtgaaatttattgagtgtttgctgtctcagattatgagtttaagatgtttatatgcattatttcacctaagcctcaacaaccttacggggtaggtattttgttctcccccagttttacagatgagggaactgaggcacaaaataatatacctaaagtgaaaaataagtattgcagctgggattccagtcctggaaacttgatttcacatttgtgttcccaactagaacaatgtataattagtgattctgtgctactgtctttggcaatttcctagggaaaaaaagtaatcctgaaataaagttgctgagtcagcactggatattttaaggacttttgttatgcatcgccaagttatgttccagataatttctccctcaaatagtgtaagaaaaggcgcatttccccatgtctttattaacactaggctgaatatagtattttaaaatcactattttaattgtcatttctttaattgtgagatgaaatgttacattcttatccaccttttaattcttttatgaatcactgtttatttccattgtggtgtttgtcttttactggtttctaagaactctttatacattttacatatgattgtcgaattgctgcaaataattttcctgttagtcatttgaaatttaaataggtttttctttttacgtttttattgtggaatctgacataccttggaacagtgcatagaatataaatgtacagcttatcaaatgattatgaagttaacaactgtacaaccaccagttgaagcaatggaatcttgccagtttcccagaagttccctgtgtgttccttcctgatacaatctatgcccaactttctagaagaagccacaattgtggtagccagcttcacagatggcccccagtgattctctccttctggtcttcatacccacccaggattgttccaaggtgggccagtgcgaccaatagaatatacagaaacagtgcgatgttgtattccagattgggttataaaagactgtggctcccatcttgggcttgctcactctctcatggatgaatcactctgggggaagccagttgccatgtcttgacgacactcaggcagccctgtggagaggccccggtatccaggaactgaggccctccttccaaaagcccttagagaactgaggcctgccaacaaccatgtgggtgagctgggaggcagatcctctgcctttcagatgactgcagccctggcccacagcttaactgcaggctcatgagaaatcctgggccagaatcacccacctaagctgctcctggattcctgactctcagaaactgcgtgagataacagccatgtgagctgttttaagctgctgagtttgggggtaattttttagcagagtaatagacaactaacataactattctgacttttataataataatttccttctttatcattacaattttaccaccaatatgtatgcatctctaaacaagatagtttaggtttgcatatttttacctattttatacatgtattttaaaattgggtcttatctcgatattaggcatatccctatagttgcatatagccagcgctcattttatttgcaatctagagattcattgtatgaatacaccacttacatacgtatctgttctcctgttcgtggtcatcggtgttgtcctgggtttgagactattatgaaaactgctgcagtgaatattatgggcatgtttcctggtgcacattccacaggcttctctaagttgaccttgtagtgcactcgctggctaaaggacatcggcatcttcactttttctttaacattactagataatggccaaacctcatcaaataatgccagattatactccaatctgcaggacgtgaaagttcccattattttacatccttgccaatccgtggtattattggtctttctgatttttgcccatctggtgagtatgtaagtgatatctcattgggattttaattttgcattccctgggagtcaagaggttgtgcactctttcatttattgattgactacttgaatttccttttttttttttttttttttgagagatggagtctcactctctcatccaggctggggtgcagtgatgcgatctcggctcactgcaacctctacctcctaagttcaagcgattctccgcctcagcttcccaagtagctgagattacaggtgtgtgccaccacactcagctaatttttgtattttttagtggagacatggtttcactaaatgttggcgaggctggtcacgaactcctgacctcaggtgatctgcctgccttggcctcctgaagtgctgggattacaggcatgagccactgcgtccggcctgaatttcctttttagtgacatgcttgttcaagtattttatccatttttaagaaattagttgtctttatttatttgtagcagttctttacatattctggacactagccctttgttgttatatgctatacaaatatcttctcttactctgtagtttatcttttcactctctaaagcctaatgatgtcttttgataaaagaaattattttactgtaatagggtttattaatcttttcccatatttgttttttaacatgtaggtttttttcgtagttgattttattagtctttgccattatagttcctgacttttgaaatcctgtttagaaaggcatccctactctgagattacacaaatattcacctacatgtggtggttttatttttatgttttcatttaaaaatatttaaaccattcatctgaaatttttttaaagctttggttataacattttttttccctgaatgtgatgaatacggttagcaaatttacagaataatctgacctcttcctactgtaaatgctacccgtattatgaagtgggatcctatatattggctgtatttctgagctttctcttttgttaattgctcattctgttgattctggcactttctgacacctacttgtagttgttgtgctctgcgggacacatctgatagggcctgctcctgcacgttactcttgtttttcggcattgtcctgacattttttacatttttgttttctagatgagctttaggatccctttaatattaacataattatttttggctgtgttgtagatttgtctgtgacttgttagaaattagtgttcccacttaggaatgtggcatgtcttgccatttacttttgaatctttttatgtccctcagaaaaattttgtaggtttcatttcaatagaggtctggcaaattcttattctaagtttttaaaattttttgtttctggtgtgaattggcccttttctcctatgcgttttctgatgcataggttttcaaacctccactccttcagcgataaaggctcccaaggagtggctgaaggctggggagcatcgcagctctgccccatctgtttaccgtaacaggttttgtttatagaaatcattctcttttgctaaaaaaaaaaaaaatttcctgattggttgttactgaggtttgaaaccctgtttttgtgtacgcttttttttttgagacggagtcttgctctgtcacccaggctggagtgcagtggcacgatctccgctcactgcaagctctgcctcccgggttcatgccattctcctgcctcagcctcccaagtagctgggactacaggcgcccaccaccatgcctggctaatttttttgtatttttttagtagagacagggtttcaccgtgttaaccaggatggtctcgatctcctgaccttgtgatccgcccacctcgacctcccaaagtgttgggattacaggcgtgagccaccgtgcccggcctgtgtacacttctttttaatgaatgatctttactgatatcttttgttggttttaattacttttttagtgattcatcttggatcttccaggtattcattcctttattattattattattttttttttgagagagagtctcgctctgtcgcccaggctagagtgaagtggcatgatctcagctcactgcaaccctgcctcctgggttcaagtgattctcctgcctctgcctcccgagtagctgggattacaggtgcatgtcaccacgcctggctaatttttgtagttttagtagagatggggtttcaccatgttggccaggctggtcttgaactcctgacctcaggtgatctgcctgccctggcttccaaaagtgctgggattacaggagtgagccaccgcgcctggcctcattcatttatttattgaaaaaatatttattcagtgcccacccactgtgtaccagacacatttctaggtgcttggaatatatctatgagcaaaatccatgtatatcatatggtaagctcaaaatgagtatattatacggtaactactttggagaaaaagaaaatggatcaagggttctagaggtgggatatgggatccaggcagaattttattttattttactttattttatttattgattgattgagacggagtcttgctctgtcaccaggctggagtgcagtggtgcgatcttggctcactgcaacctccacctcccgggttcaagggattctcctgcctcagcctccggagtagctgggactacaggtgcgcaccaccacgcccagctaatttttgtatttttagtagagacggggtttcaccatgttggctaggatggtctcgatctcctgacctcgtgatctgcttgcctcagcctcccaaagtgctgggattacaggcttgagccaccgtgcccagcccaggcacaattttaaataccgtggtcaccataggtctcattgagagggggacatttaaacgaagacttggaggtaaggacgccggctatgtagatatctgctggaaaagcatgcttggcagaggggaaagcctgtgcaaaggccttagaaacacgctggaggtgttcgaggatcatggaggggtgtggctggagtgcagtgagtgagggagtcaaggttggttagggagggatagagtaggggacagatgtttgtatggggccttagtgtaaagactgacactgagtgaagagaggagccattgcagagttctggaatattgtagggacaagatgggcttacttttttttttcttttgagatggagtctcgctctgttgccaggctggagtgcagtggcacgatctcagctcactgcaacctctgccttctgggttcaagcgattctcgtgcctcagcctcccaagtagctgggattacaggcaggtgccaccacacccacttaatatttgtatttttagtagagatggggtttcaccatctggttggccaccatcatgttggccaggatggtcttgatctcctgacctcgtgatccgcttgcttcagcctcccaaagggctcggattacaggcgtgagccactgctgggcttacatttttaaaagatcattctggttgctcctttgagaatagattttagaggggccggggtagaagcagggagactgattagaggcgattgtaacgctcctcacctaggatcttactgtgcattgagcaattggtaaggcttatggaatgaatgtttttacctacatcgggcattttagcgtgcattaagaaactacacatttaaaaaatacatatttttcttgagaaagtgatgggacagaaaagtgagagcaggggaattgcctttggaacaggccattttggtcaagccttgtcctggataaagaagatggggaatgaaggctgacctgccgtggaggggaggaatgggcaggcatgccctgcctcatctcacggagtgagggcagaatctggggagcgcgttcttggatgtcccaccaactttggagaggaccggaggctggggatagacaaggactactatgatgaaggaagctcgtaagttcgtgtttgcttctaaatggttgctgtggctttctggctttaaactggtttatattttctgcaacctcacttcttcctaactatttagtagaccagaacttctcggtaatttattgctcaatagtgggagaaaggaagaacttcgttttcaggttaagacttcatatgtcaaatccagttttattggtgtgataaatgctggtttctgttaaatttaccaggttggtcagtactggttcctgatacaagaactgtatttacccttttaagaagatgatttaaacttctggagaaaggaagagggcaaagatctttaaagagtatgctatttttatgacgcctccctaattattcagaaatatgaataattcaggaatttaactgtagaataagtataaattacccggttactgccttgaaagagtttacaatcaccttgaagagaatcctgccctcacccccaccagtttcacaaagcctattttaaattatacccttggaaaaattaaaccaaaacactgcgcaaatatgtttggtgtggagttcatttctttgatttagtcctttcactttgggcccacacacttttgccatcctttagggagcatgcccagtgctagattcgaagcgaatatattaatgtatgtgttcacccatcaatgccttgtgctgagggaaaaacagaagagagtgtcatggaaggcttaaggattcttttttttttttgctgatacaaagtactttttgttattcaatgcttgtgccatcatcagacaacttcatccagaatgcacagcaactctgtaatatagctctgcctggtgcaaaatacctcattttgtatagaaatgcaggattgcttcatgtagatacaatagaaagaatctttgctttattcatgtatgaataaaacgtctttgttcatggaagagaaaagtgcctcttattgtttggaagctgtgtgaattttaaattaagctgatggcccactatattacatatttcgggggaaaaattagctttgcttatataagtttggaatctaatgtctaacctagtggcctaaataatttttgctttgcagtttgtttattatgtaaagacattgtgtttgccacagacattgcctgtcaatgaattgctttagcaaaattctatagtcctaattttaaaaagttgttatttattcccttgtcccacataagatttgaagcagcttgcaaaaaattaaaaatacaatgtaaataacagtcataaatcatgatcagagaaaatataaatattttatggaaaagtcaaagcttgtagaggcatgtgtgagtgtatttatgtgtcaatatacatgtaaaagggtccatgaagcagctatgtggatcctcagatttgatgttgagcttcctggcagccaaagtggaaaaaggaaggcaatcagttaatcctttctctgggtttgcaaaggactgcttagagcatatccaccgccaagcaggggtatggcattcgggctttcccaaaagaaagctggccactcagatgttctcactcataggtgggaattgaacaatgagaacacttggacacagggtggggaacatcacacaccagggtctgttgtggggtggggagaggggggcgggatagcattaggagatatacctaatgtaaatgacaagttaatggttgcagcacaccaacatggcacatgtatacatatgtaacaaagctgcacgttgtgcacatgtaccctagaacttaaagtataataataataaaaaaaagaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacgtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcacctgctggttccctcacccagtacatcttggctcccaggaagccacacccttgacatttaccatgcttcctgggcatttcctgctaccatccccaccctggacagggctaggatggtatcaggacttagtgctgcacaagctttcaggataccgggtaagaggggagtttgacacttggaacaatactggacctaaaaggagccaggccttggatggacagtcactctccatgagtttttgcaccatgtcagcactataaactcactgcagtgggagtttcgcattgacaagggtcttcagacctagctcacctcagaaggtaaggggggccttgacaggtcctctcaagggggataaatgccacctgctatttaaggagacttgaccccatccctgcttctatccattaatgggtgactttttaattcttctggaactcttattgccaaggtcttggtgggactgagggtgagatcgcttttctgtaacacagatgcattgccattttgctccttgatagtgtaagatgtttaagtcaattaagacaaaaatgtgcttaatactcttttcatttgccttaacaactccacgtttatttaatatcagtttaattcttggctgctgcaaggtctgggtagttttcatttcgaaactactcctagggtgagaagtctcttaagtgcctgtggtattcccaaagaatttgcttttgtgcggcagtcacagcctggaagcgcgctgctttctttgctcctggtgtcagaaaagctactcctggttctcagattgggctttcctgcacattagaattggaaaggtcctctttgtgtctgcccctgtaagggagccaaacaaaaggcgccagagtggtggtagggcagcatcatcgctccctaacctccaccctcctccttctctcttccttcctccccgtccctgcctccctggcctccctactcctccatcccctccaagactctcaatgtagtcagcgctctgttttccccacctttgcctggctgccacctccctccctccctctccctatcagcttcctccggatgaggtgctattctgcatggaccccttagagtactcattaactagatgaataagctgccagcaatattgttcctgcttcccacattttaaaaaggttatctctttctttttccttctaaactttagagccatttgaaaataatcttttggaaatatatttacataggtctcatgacaaatccacatactccttttcagacaggtttcaacgactgcataatgagatggtctgggtcagctttgcacaaaagttgtacttttcctgctgtgaatctgtatttttccgctgtgtgtatttgcaatgactttcccgccctaccttccactagtgatgcattaatcacagcatggagctgagaggcgtgggattggaagggtctttgagaagttttttaatcgagctagaacgaggtcaaggttttgagcatttaacttgtgggatgttaattacttggctatgaaaaggaaatttgttttctgaaagttcaactgtagctacagaataaaggccatggaaagataaggcatggtgtcaagaggtttcatgatcttattccacctccttttcaggccccaactccactcaaaccctccactgttgagccacactggatgtgtcaccctctgtccctagacgtgctggacatctgcatcctgtggtgcctcggctcaggcttctctttcatctgggaaaacccttgaccctctcctagacttcccaaatgctgcttcaaggcatcatccctgccctccttcctttagaaagtcttttctaccactgagaacacttccctcatgctccaccgcagactgtacttcatgctgctttgctctttgtggttgatgcatctgtctctcccactaaatcatgaccctccattcatttctacttcccactctacccagggcatggtaggtgctcaataaatctttgctgaatggaattttttcatctaacccaagagcaacctgagcagaaaatcataaatgaataaggatcgtaaatggatgatcatcataaatgactaatcatcataaatgaatgcttatgggatatacacaaattgcagaacactgatagctatggcatagctcttatcctagagtgagtttcaattcactttaggttaggacatagaaaagacaaggagaaacaactagtccatgaggattttttccatgctttgttctttccatctgtgctgttcagtagctagtttcactgagcttccctgtagtggatgggtagagattgtgtattataagtacttgctcatcagtggctcaagggcaaaaatctcagtgcctagagtttggcataatattatgtgaaaaataattttttgcaatataatgagatgtgacactccccactttccagaacaaggacttgtctcctttggatttccagacctaaagaagaacatctcccttgaaaaacttttcccactggcaattcagccctctgttttccaaacccacttagaagctaagttgcactggaaatacacaatgaaatgtttatgggaaaaaggggcatcatatccacaatttgttctcaaaatgatttagtggagggagagagagagagagggtggaaagggtgggttggagggagcaaaagagagacagagaaaattgataaaataaatgagataaaattgagggaatctggcgaagtctattggagcattctttgtagcattggggaattctttgtcatatgcttgcaacttctctgtaaaccagacattatttcaaaataagtttttttgaaaagcaaaagcaaattctttgaattcttacccagtttaaaaggatgatatgattgcaaaaaagttgtgtttctctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggctgggaaattcccctcaccgccaagatgtccatgtcctaatccctaggacctgtgagtgataacttatatgagaaggcaatgcgaggatggaagcaagagattggagtgatgtgaaggagagatcagggtccaaggaatgcacatgacctctagaagctagaaaaggcaaggacacggatcctctctcctagagcctccagaaggaaccaaccctgccagccccttgattttagccctggaagactgattttagacttctgacctctagagctgtgagaaaataagtctgtattgttttgctactaagtttttggtaattttttatagcagccagaggaagcaaatctactgggtgagtggattctatgcccgagttcataagtgagagtgaggccaaggcatgagttctggattattgtcattagcatttcaaagaattgtcctctggctcaaatcagcggtgttcacactttgcttaattgcctgtgtcttattttgttctccagctttgatcacatgtatgacaaatggaatcggaatgaattgcagaactagcaggtcgagtgcttgacatcacctcacagagatgtcatggatgctttgggaagtgctttgcttgacagtgcctggatttatgtagcaagatattttgtcctggggtaaagggagcccatgcaggtggggggggaggggaagggaatgggagctgatgcctaggcaggtttctcaaacctgtgtgaattaaggacccctctccataagggacttttttggtgtattgacttaaatttagttttattatattgctacttaaatctgtataaacataaaactaagtgttaatttatgcttatagctttaagacaactataaactccaaacatttcaaattaaatgcaaataaaattacaaacctaataaaattcaaattaacatcactgagttaatgtcatggataacgttttgctgattttaaattgatgttctcaatgtgttttcacacacactcgtgaagttatggaacattatctttgtttctgctggacttgtttaattcactgtaaaaatatcgttatgttgaaagaaacatatacatcacagtaataaattgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtactgactgttggatttttataaagtgaacactaatgttaccccatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcgggaagataacaatcacagtggaaggcgaaggagcagcaggcacgtcacatggcaaagcagaacaagggtgggggaaggtgccatacacttttaaatgaccagatctcatgaaaactcactatgaccaagacagcaccaagtcatgaggggtgtgcctcatgatcaaacacctcccaccaggccccatttgcagcattggggattacaattgaacatgagatttgggtggggacaaatatccaaactgtatcaggaggcattcctaaatactgtgaattgaattttgcctatttttgaacttctaaaattagggccatatcgtatcttttgtgtttgactctttcagtcaacatttttttttttaaagatacatccatgttgttctgtatgactgtagttcatttttatggcagtatagaataccattgtataactataccatacttttttgagctattttcctgttggtagacttctggggtcttttcagtttttggctattacaaatattgctgctatgaacatacttatacatgtctcctagaagacttgtatctaaaaatagaattgatgtgtcatctggtgttcactgctagatgatgacacattgttttccatgtgactttctttcttttctttttcttttcttttctttttttttttttttttgagatggagtctggctctgtcgcccagtctggagtgcagtggcataatctctgctcactgcaaactccatctcccaggttcaagcagttcttctgtctcagccacccgagtagctgggattacaggcctccactaccatgcctggctaatttttgtattttttagtagagatgggatttcaccatgttggccaggctggtcttgaactcctgacctcaggtaatccacctgcctcaccctcccaaagtgctggaattacaggcgtgagccaccatgcctggccatgagtttcattttaatttgtgtttccctcattttgattgaggttgagaaccttttcgtatatttattggtcatttggatttcccttgttgtgaaaggtctgcccaactattttgtccatttttctctttttcagtcttcttattgatttgtagaatatatattcattctggatataagcccttgtcggttttatgtcaaaattatttattttgcagatctctctctcttcttttaaaaataattttaacctttaatttagattcagggggtacatgtgcaggttttttatatgtgtatattgcatgacgctgaggtttggggtacagttaatcatgtcacccaggtactgagcatattactcaaaagtcagtttttcacccctcacctccagttctccctcccccttctagtagtccccattgtctattgttgccatctttgtgtccacgagtacccagtgtttagctcccacttataagtgagaacatgcagtatttggttttctgttcctgtgttaacttgcttaagataatggcctctagctgcatctgtgttgctgcaaaggacattatttcattctttttatggctgcatagtattccatggtgtgcaagtaccacattttctttatccagtccactgtcgatgtgaacctatctttgctattgtgaatagtgctacgaatgaacatacatgtgcatgtgtccttttggtagaatgatttattttcctttgggtatatgcccagtaatgggattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcattgtggttttgatttgcatttctctgatgattagagatgtggagcattttttttgcatgtttttggttgcttgtatgtcttcttttgaaaagtgtttattcatttattttgctcatttttcaatggggttatttgttttttgcttgtgcaattgtttaagttccttgtaaattctggatattagacctttgttggatgcatagtttgcaaatattttctcccattctgtggagtgtctgttgactctgttgatagtttcttttgctgtgcagaagctctttagtttaattaggtcccactgctcaagtttttgtttttgttgccactgcttttgaggacttagtcataaattctttcctaaggctgatgtccagaatggtgtttcctgggttttcttctagaattcttatagtttgaggttttatatttaaatctttaatccatcttgagttaatttttgtatatggtggaaggtggtggtccagtttaattcttctgcatgtggctagccagctatccctgtaggtgtgcagctttatttctgggttgtctgttctgttccattggtctacatacctgtttttgtaccagcaccatgatgttttagttactgtagccttatagtactgtttgaagtcgggtaatatgatgcctccagctttgttctttttgctggtgattgctttggctatttgggcactttttagattccatatgaactttagaatagttttctctagatctgtgaaaaatgatgttgctagtttgataaggatggtgttgaatctttagattgctttgggcagtttggacatttgaacgatattgattcttccaatccatgagcatggaatgtttttccatttgtttgtatcatctatgatttctttcagcagcgttttgtacttctcctcgtagacatatttcacttccttggttagatgcattcgtaggtaattttttgtgtggctgttgtaaacaggattgcattcttgatttggctctcagcttgaatgttattggagtatagaaatgctactgatttttgcgcattgattttgtattctgaaactttactgaagttgcttatcagttctaggagccttttggtggagtctctagggttttctaggtatagaatcatgtcatcagtgaagagaaatactttcacttcttttcctatttggattccttttatttctttctcttgtctaattgctctggctaggacttcctcttccactctcttactggtatctgttggtcagtggaagttcttaattttagtgtagtcaagtttatccttcttttccgtatatggtaagtatctatacgtgtaagtgtttatacgtagctgttttagacatctttttcaatcccagattatgaagctactctttatttcatcttctaaagctttatagttttgtttttcacatttagtattgtaagtcaagaactgtggagtgtctgaaattttgccttacttgcaagctaacaagttagcctgccttagtgtcacgaatgttgccagaagacacaagactccgggtcagagggtcggagacaaatgactttgccagagtatcggcatcttcttgtgccagttcccagagcccaaattcctacagagcaaatgtgtagagggtcaggtgacttgtacacctggagtgaactgtgttagaggtgaggagccctgaggctagggaacccaaatcttttataatgggctgtaagcttgcctgacctttgcccagagggagaaattgtctttatatactggacagtaaacaagtctgtcattttccttggggagagacactatatcttctaagactgtttgccatacaaatatcctttgaagagatagcaaagaacaaaaaaaagcagagtgtctgccttcaagacttgcagaaacatgagggatttagggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcgttgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactatctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcctcttactgatatttattcttccctttccagtctgaaaagcagtctccatggcagaataattggtaaccaaatgtagatctatctgcaatggaaagtgacattttgtgagcaaaacctcaactttttaacaaaagaaaacaaaccgtagagcaaaggagattttctttcattagccagggtccagttaggatacaggaaccgtgctaagtatttcacatggaagggatttcatacagggatctggctatacagggtctgaaagtttgaaaaaattaaaaatggacactacctttaggtgctgggtgacaaaagggaagaggtggcaatataaaatctaggtgctcagagaaggagctaccttggatggtgctgaggatggggaggggagagctgggaatggaatggcccaggagataccacagcgctcctgctttacccgctgctggaaggatgaccgtcaaggctaaaagcaggaacacagtcctttcttcccagctccttctttccactgtcacaacataaccagaagccagcagcaaggaagcctgagaaatgtagattgcagagtagaatcactgagtggaggttggggctgagagacaataggcaaataaccagcacagagtctaagcagcaaaccgttcagattagctcctcctacaacaatgtgaaaattggaatgctcattttgttgctacttctaggaactgtggcccgtgggtcagttgggaattaatggcaaataaaggagattctggggcagtgtttgcttatgtgttgtgtctgattaatttccaaaatcaagctgaattaattttggatttatatgcattcatttttgaggtcaaggctagaggtcataatatctgaggtctcattctcgccacttttcctattgctggaatagtggtgctatgtcggggagaggacacagagaggaacaggcactgagaaagggagggaaatagtgggttcagaattgggacatccaggaggcagctggaaacgtgagtctggaactcttgggtgagatttggggctaaagataacaatttgggtgcttgatggtaagcacatcctttgagagtatatgcagtttcccaggagagaatgtgggagaagagttgagggaagggttgaaaaccttggaggacaccaacattttcaaagttagaggagccagcagaggcgagctcatcctaatggagatcacttcgttcaagcagattatttgcttgaaactttcatctttggtattatttgcactgtagtggaatgaacaaccataatgtgagtttaaaacccagataccaaaatattgtttgtttatagtctccctcaaactccatcttccgtaagtgctggtgtggggattatgtacctcttcacttctcttctctgcactgttgataaaggaagaggcaggttttgctgaccacattttggcaaatctgttggctctttcttgggcattcccatgctcatggtcacaatactgttactacgttaatttaactctagaattgagtttaagccactaatcacaatttctttttcttgctttgtcattatagctgctttttgaaaagcaaaattactaaatttcttaagtcaataatttcaggttgataaagaagaggcaaaatatatgcaggctttaaaacatgctctgagaccacagaagggtctttttctgatccaaatatcctattaaaactgtgtgactataggaaaaagtctgtgtaggctagagcaagttcagttgaaaacctatttttaaaaacacttaaataattacctttcatcctaaatcatagacatggtcagcattgtaagaaaagctgatacacccaaatctgaatatatatgacaaatagatcattaacaccctttcattttaccaaagtattctttgatagtgcctttaaataagccagtttctaaagtaaatttaaaatgtcttcaattataaaaaatagatttacatgtgatgtttcaaggacatatcttgtgaaggaagtacagttgtaaagtgttgagcaaagtcatgaaagttttcacaagaaggaaaagaataacatttatttctaccttttcttttttcttatcagcatctcaaaatagaccaacagtatattccattgttactatttatttgctgcaatacaaatgacatctcatttgattttagccctttaaccttgagctaaaatgaccctgtggaaacaaatgagcactgtagagacacctgcccctcagaagagtttggaagggcagagttctgtgggagagtttgcctaggaagtggtgcggggtgggctgcccgggaagggtgtgtggagtagagaccaagaaggggctgaacgccatctcccaggaagcttcccaagactgacttttcttatatgtggcctccaggcagaggtggggaaatccccaagccttcccagagggcagtgaggctttctcaccttaacttttgagttaggaattagttcacattagcagtttttggctccctgaggctgagattggggagcttttctgaaatcatggaaatttctggcccttatctctagatgaagatcccaccttaattttatgtatccaacatagcctaaactattgttctttttttctgtctctgtcttcctttccccctgcctccctccttctctctcttctttctttctttccttcttctcatttcccagtggtctggtctccaaaaacaaatgaatgtgtgaaatcagtgaggattcttctccctggaaacaatgtgttgttggcaaaagcaacaactgcctctgcaaacatcaaaatcctccaaaagagtgaatggggaagatcatatttggtgttcagcaatctaaaaaaaaaaaaaaaaaaaacagacagcaaaaacccagaggaagtgaagaaagttagtaggaactggtaatactatacagatgatttcttctccacctgtttggaagttttgcttaagtctggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcattttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctattttgagttgattttgggatatggtgagagatagggatccaatttcattcttctgcatatggataccgagttttccgagcatcatttattgaagagggtgtcctttccccaatgtatgttctgggcatctctgtaaaaaatcagttggctgtacatatgtggatttatttctgggttctctattcgtgttctgttggtctgtgtgactatttatatgctgataccgtgatgctttgattactatagttctgtaatttttttgacatcaggtagtgtgatgcttctagctttgttatttttgctcaggattgcattggctatttgggctcttttttggttccatatgaattttatgactgatgtttctatttctataaaaaatgtcattggtattttaatagggattgcactgaatatgtagattgctttaggtagtatgttcattttaacagtactaattcttcctggctattattaaaaagtcaaaaaaatcacagatgctggtgaggttgaggagaaaaaggaacacttatatactgttggtggaattagttcaatcattgtggaaagcagtgtggtgattcctcagagagctaaaaatagagctgccatttggcccagcaatcccattactggggtatatccagataaacataaattgttctatcataaagacacatgcacacatatgttcaatgcaacactatttgcaatagcaaaggcatggaatcaacctaaatgcccatcagtgctagattgaataaagaaaatgtggtacatacataccacggaatacaatgcagccttaaaaaagagtgagatcatgtcatttgcaggagcataaatggagctggaggccattatcgttaacaaagtaacacaggaacaaaaaaccaaaaactgcatgttcccactcatgagtgggagctaaatgatgagaacacatggactcttagaggggaacagcagacactgggccttccagagggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttctttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtttctttgttaattttttgcctagataatctgtctaatgttgatagtgggataaagtcttccactattattgtattggagtctaactctccctttagatataataatatttgctttatatatctgggtgcttcggttttggtgcacatacatttagatttattatttcattttctttattgatccccttatcattatataatgatgttctttgtttccttttactgtttttgacttaaagtctgttttatctgacataaatatagccattcctgctcacttttggtttctgtttgtgcagaatacctttttccatccctttacttttagtttatatgtgtctttacaggtgaaatgagtttcttatgggtggcatatagttggctaatgttttttaattcagccagtctatattttttaagtggaatatttactctgtttactttcaaggttattattgatatgcgaggacttattgtcataattttgttaattgtcatttggttttgtggttctttgttcctttctttctctcttagtgtttatcattgccacttgcaggtcttctgtagtggtaacatttgaatctctttttttttcctcatttgggtgtttgctctaccagtgagttttattcttttgtgtgttttcatgatggtagatatcatactctcacttccagatttagggctccgttaagcatttcttacagagctggactagtggtgatgaattatcttgtttttgcttgtctggaaaagactttatttctccttattttatgaaggataactttgctaggtatagtatttttggctgtcagcttttttctctttcagcactttgaacataaacctcaagcttattctctccttgcttgtaatctttctgcttagaaatctgctattagtctgatggggggcagttcccttatgtgactagatgcttttctcttgatgtttttagaaatctctgtctatctttggcttttgacagtatgctacagagaagacctttttaggttatatccatatctatttggggatctctgagattcctgtatctggatgtcttaatctcttgctagacttgggaagttttcagctgttattttgttgaatacgttttctatgcctttgtctttctcttcattttctggatcatccagaatttgaatatttggtcactttatggcatcccatatgtcatgtaggctttgttgattcttattcattcctttttcctttttcttttttgtctgattgggttatttcaaaacatttgtctttaagttctggaattcgtatgcttaatctagtctattgttgaacctcttgaataaattttttatttcatatattgaattcttcagttccaggatttctgttttgttctttttttcatatctgtctctttagtgaatttctcattcacattctgaattgtttttctggtatctttgtattgtttatctgtgtgctgttgtgtcttactgagcttccttaataacattattttgatttttttctgatatttaaaaaatttctatttcattggaatctgttgctagaaaactattgtgttcctttggaggtgtcatatttccttgctctttcatgtttcttgtgtttttatgttgatatctgcacatctgatgtaacagtcacttcttccatttttttggattggctttagagggggaagactttttcctgaagatgtgtttatgttgatggttaggtatagtgccttagctttgattctgggtgcaggcattggtgtagtctcggtatgatttatttgattgtgaacagcatggtgtctgtgattgtctcagtggcctggctgtggttgttagtggatgctgtggtgatgctttgctggggatgcctttgctggccccagcaggtgggccagtcctttgtgcccagtggtggcagtggtgggccaattatgccagccattaggctgctgggcagtgtacatgggcaccagtgttagcagatccaggcaggctgattcttgggcctccaggtggcttgctcagattccagcagtggcagcagtgggctggatgagtgggcaggtcctggggcccctgggcagtgtgtgtggcatgggagatagtagtaccagtggcaggacaacccttaggcttccaggcagttagtgatgttagtgatggttgtgatgggctgggtggcccctcctcaggtccccaggagtacaaagataccagtggtggtggactgggtagagtgatccgcaggcccctgggtgatgtactcaggcactcaagtcaggggtggttgtgccaggctaggtggtcctgtccttaaccttctgatggtatgcacgagtgcaggctgtggtgggacaatctgtggtggtgggtggggagagcttgtccccaaggtgcagataagtgcgcagcatccctgctgctcagtgggtggggcgggggtggggtggctgttagtgggagtgaccctaggcatttgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggtatcaggggagtgtgtagagcactgttagttctctttctggagcaaggcctttgcacaatctctaggcagctccctgtgctagtctcagggcccaggaggatagagaggctcttccatggctaagatgacaggagtcaatggtgggaatgtggacttcttgggatctcttaccctttccctgcaccgggaacctctccaggcttctagctgatgccagctgaactggccgccttgctttcccttactttctgtgcctcaggtgtttcctgtcacttctctgctaaattccagtgttttcttttagatgttctatttgaaatgtgattatctatttcctattttggttcttttttggggaggtggtgagtgccagatacctctagtcagtcattttgaacctccccggcccctcctcaggtcaactgtttttttttttaataagaggatttttgccccttaattttctgggattatgtcccatataattcttgtaaggcaatctagacaaaattttcagtcattaattttgtgctttttttcttatgttgaaactactaaaacaacaggttggcttttcttcagttaatcatcatgattcatcttttccattatttgttaatttgccatctagcaattgtatgatgacaaattcttttttaccttttaaactttactgaaggcacctaggccaggagatcacatggttagagacattacatttatttccttccaacacaaagaaagacagcaaatagtaacaaccccccacccacacctatacccaagcaaaacaatattatcatgtttgctatcctacaagatccaatttcccttgacttttattggagaaaagtgtcagtactagaaattcaaacagaatccttaacatgcccacagattatttcagggatccttcagttcattttcttgagcagtagctggtcagagggcctactactttgtgtgcaccattctagtgctgaggataccataatgagtaatattcatgagtaagaccgtaatgaatataagaccctgtccccaggcatctcataggccactgtgggaagcacatcaataaatttcagcgcagaatggttaagtgctgtgtaagcttttaatgtattcaggagatctgcagaaggggcacccaactaggtctgaggagtcctaatgacctttgaaggctgtgtaggagttagctatatggaaaaacttccaggcaatgggaacagcatataaaacggcagaaaggaacagggtgattctgagtgaccaagagtttaggaatggagaagtgtgaggtgtttatgaggagggcaatgaatgaggctggagagaggtaagtggcaggcagatcgtggaaggatggtacactgtgttgagtatggattttattttaaaggtgatggaatcactgaatcactttggggaatagcattattcaacgggtgttttggataactcattggcagttgtatggaggaagaatttgaggagtcagttaggaggctgttagagcagttcagagatgagatgacagtagcctggactgaggatatgttcatgggaatggagaaaataaaatggaatcaagagatgtttgggatgtagagtggataacacttggggtggtgtgtgtgtgtctgagagagagagagacagaatgagagagagagagagagatgagagagatggaagacatatatgttagggaactctatgcagcatttgtggctctgaaggtttttatttggaaggtgttgattgaatctgtctttttttctgaaaacttcagcatgtacaagttgctgacttattggctgtttttaaaaacatctgaattctatatatacttctgagagtccattacatttttcttaggtctaggacagcttttagtttccagactatcaactgtgtgggtggtgattccactaattgagagaagggaagataggcaaataagtagaatgatgagtttgtaaattgtgtttgaggtatctttggaatatctaaagaaaatttccaaaaggcaattggatgtgaaaaaattgaagtttgagaagtttgggttggagttatggattttcaagtcagtagcaaaataggtgattaacgagttcatggtaatagacaaaatcatcccaggagattatttagggcaaacatgatagaaggccaaggttgtaacactaattgagaaaaagaaattataaaggtaattgagaagtgtctaaggaggaaggggatgatatttagactgcagaggccaagggaaggggtggtttcaaggtgggagtggacagtagatttagaatgtctcagatcatctaagctaggagcctgaatttatcctgggtatgaaggaattggatggtcattaatgacagcagttttaatggagccagattgtaaggtgtatcagttaggaatgagtttggctgcaagttaaagaaaacctaaccatagtggcttacagatctaggcttatttttctcatctagcatgaagtccagagatgggaggctgctggtgtttgttcaagaacttaatgatcatcagggtcttcttgcaattctcgaagcttattccttataatctcaagctgattgatgcagcctcatacatgttcatgttcaagataggaagaagggaggaagagtggcatcttcaaatcaggaaaccagtaatttccaagaaatccccacctgcagctaactacttaggtctcattgcccataatgagacatatgactacctgtagtcacaaggaatgctgggaaagcagggaatgttctggcatagtgatcattgcctgggctgggcccattgacactgtatgcaaaatttgggttctgttagtgaggaagaggagagtgtttattgagtggccagctaacagtgttggacttacataggttgagaaatgaatgggaagtgagaaaatggggacagtccatgtctatgacaccttaagaggcagttctgaggagtatggactagaaagggtggtagccagagtagaatatggggaaataatggaaggttacattctagaatatgaaaggcttgagtacatgtaaatgttgatgtgagtgggagagattgaagatgcaccggagctttcacaccccaggacaatacctagagacttgggatgggtgagggctgtgcttttctattgtaaaatggcagaaggggttcatataggagcttctgaagacaaatcggttaataggaaagagcatatacagaggcttaggatctggaaatacagtcatttaaaactatccatgttcagtatccatgtgtttccagtttaaagactactgctttaaatcatataacagtttctgttcagtcattagcatttccagttctatgtgataatcacaagttgaatgctgacttgatgttaattttctccccctccccagctagggttggcctcgggtagggcattgccacagggagggtgtgtgctccctttgagtctcttaccccagagtttcttgccctctgggtttggagtgtaggatgaaaggaggggaaagtggggcagggaagtttctgtttctttggtgattgcagtatggctttgatctctctggtccctggcaggtgttcagagctgacttattcgcaggtgtcccatttccttgctgagccaatttgtcttccctctggttagtatttacttgactcatgcaatgtacgtttttatttctggtggtactaactttttaaggatcctcttgggaagtatctccttaacttgggactcacttctggtcccagggtttaccaggctttgatctgccttgatgtttggggtgctgtgtttcaatatgttcccatagattgtgttggaagctcaattgctactgtaacagtattaaaaggtgggcctttaggaggtgattaggccatgaggtcttgctcccgtgaatggagagagtttggcctctattttctctctatctcatgtgctccctcctcccttctgttttctgccatgggatttacccttgccagatgctggtgccatgctgttggacttactggcctccaaaactgtgagctaaataaatatcttttctctataaattacccaattgctggtattctgttatagcagcagaaaatgggtcaaaacaggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaaggcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatacaatctgatcttttaaactcatctaaatagctactcgacattgtccttatcaggcctaggtcaatgataaaggtacataacagaataaatctccctaaaggaagaaaggaaaagattaactctctcccaaatccccatgaaacttcatgttcctacatggacctgtttgtagtctggtccccagacactgttgagatctgggaacacggggtcccagaaagaaagcagccttcatgattaattcactttcaaaggttctgccttaaccattcagggtgttctaaaaagaatcttctgaaagaccacattttgctatgaaatcaatcaaaaacaaaataccagtcagaatcaaactttttaaaaggtcacactcatagaggcctccaattcatgatcattgggtacatgttgacaagctttttaggaaactttagagatatatggggaagatatcaatctcatctgtcaactgtaattgaaaatgggcaaaaaaatacaaatatataaaaactggcatcagtgctggaaactagagaagggcattgcccaacttggagaagttctgcctgatatgatgcaaactgtaggaagccacatgggccaaatcgtagacatcctttctgaaaaaaagataggatatgcaaaaagtgaatacaagtaaatcctaccagaccaggctgttactgcgcagctactaatttctatgtgtgagagctcagaggggtcagcccctgtacatattgggaacatttattctagttggaacccattttcccagagtgggtccacacttacaatcatttgcaggaagcccaaagccgagcctgaggacagcaagactttttctggatatggtggacagggcatccaggaagtgtggggtcctgggcacactcagccaagactgggtggggccaaacctttttctgtttcctgtctcatgttcttgtgctgggacatttccttgattctgcctttttctttttcttttcttttcttttcttttttttttttttttgagacagagtcttactctgttgcccaggctggagtgcagtggcacaatcttggctcactgcaacctctgccttcgggttcaagtgattctcctgtctcagcctcctgagtagctgaaattacagggatgtgccaccatgcccggctaatttttatatttttagtagagatagggtttcaccatgttggtcaggctggtcttgaacttctgactttgtgatccacccaaagtgctgggattacaggtgtaagccaccatgcccagccaactctgcctttttaataagcaattctgatttcagttttgtccattctgtgctcactcttttttattgagttttcctcctttcatttttcatggtagccttttcttgttttgtgcatatgaaatcgtctcaaattttcctattaggtattaatgaaaactttaaaaagttcccctctatactttgattatctctgtttcctttggatcattctaaagtttcctctttgacatttcctgtcgcactcctggttttcctaaaatttctgtggtttctgattgtcagtgtatcagaatgaaggactagacccatcactgtaggtagctggggtaggtttttgtctgtttacctcacagtcttccctccctactggaaggactgagtataggggtgggtgtggtgatcagttttatgctagggtcagtggccaagggggactcagggaggctggaaagaagggttttaccttggaatgcagggctttgctcttgggcagggctgcctcttcatgttgccccttctgtctgttggaatgttgggaaagatctctagcttctctcagatctccacatccactttggggccatcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctatcctagggttatgttatcttgtagatatcataagattctaaaatctttaaatttttaccttaaacattattttaaggtcagtgaggaattatttttgaggtatggtgtaaagcaggggtcttaaattatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgctttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaattgtttaaatgttctttattctagtaataatgttttctgtataaaagtctattttgtaggatattagtatagattctaaaggtttttattgttgatgttagtgttttctttttttaaatttaaaatttctatgggtacatagaggcgtaagtatttatggcatatatcagatatttttatacaggcatacaataagtaaggattattacaatgtgtaatgattgtcagggtaaatggggtattcctcacctcaagcacttatttctttgtgttatgaacattctaattgtacttcctcagttactctaaaatgtacaacaaattattgctgactgtagccactctgttgtgatatcaaatattatctcttattcattatatctgactatatttttgtgcccattaaccatcccgattccctctactcccctgctacccttcccagcctccggtgaccatcgttctactctctgtcttcatgagttcaattgtttaaatttttagttcccacaaatgagaacatctgatgtttgtctttctgtgcctggcttatttcacttaacataatgtcctccacttccatctgtgttgttgcaaatgacaggatctcattcttttttatggctgaatatgtaccacattttctccatccattcatctgttgatggacacttagattgattccaaatcttggctattgtgaataatgctgcaataaatatgggcagcagatatctctttgatacactgatttcctgtcttctttcctagcagtgggatggctggatcatatggtaattctatttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggtaattctattttttgaggaaattccaaactgttctccatcgtggttgtacatccttaccaagggtgtatgagggttcccctttctccttgccagcattcgttattgcctatcttttggataaaagccattttaactggggtaagatgatatgtcattgtagttttgatttgcatttctctggtcatcagtgatgttgagcatcttttcatatacctgctagccatttgtatgccttcttttgagaaatgtctattcagatcttttgctcatttttaaattttattattagattctttttcctatagagttatttgacctccttttattctggttattaatcccttgtcagatggatagtttgtaaatattttctcccattctgtgggttgtcttttgactttgttgatgttgaaaagcctttgctatgcagaaactttttaacttgatatgatcccatctgtccatttttgctttggttgcctgtgcttttagggtattactcaagaaatctttgccaaaatcagtgtcctggagagttctcccaatgttttcttatagtagtttcacggtttgaggtcttagatttaagcctttaatccattttgatttgatttttgtatatggtgagagatagggatctagtttcactcttctgcatatggatacccagttttctcagcatcatttattgaaaagactgtcctttccccaatatattggttcttggcacctttgttgaaaaggatttcactgtagatgtatggatttatccctgggttctttgttttgttccattggtctgtgtgtctgttttttatgtcagtatcatgctgtttggttactacagctctgtagtataatttgaagtcagttaatgtgattactccagttttattcattttgctcaggatggctttggctattctgggtcttttgtgattccatataagttttaggattattttctctatttctgtgaagaatgtcattggtagtttgataaaagttgcattgagtttgtaggttgctttagtaggtatgaaattttaacaatattgattcttccaatccatgaacatgaactatctttctatttctggtgtcctcttcaattttttgcatcaatgctttatcgttttcattgtagagatatttaacttcttgggttaattcttaggtattttatgtaatttgtagcaattgtaaatgtgtttactttattgatttctttttcagattgttttttgtggacatatagacattctactgatttttgtatgttgattttgtatcctacaactttattgaatttgtttattggttctaatacctttctgatggagtatttagatttttccaaatataagatcatgttatttgcaaacaaggataatttgactttttcctttccaatttagatccctttttttctttatcatctgattagctacttttttttctttatcatctgattactccagtactatgttgaataacagtggtgaaagtgggcatccttgtcttgtcctttatcttacaggacaggcttgcattttttcctcattcagtatgataccagctgtgggtctgttgtatatggcttttattgtatggagatatgttccttcaatatccagtttttttagggtttttataatgaagggacattgaattttatcaaatgatttttcagcatcaattgaaatgatcatatggtttttgtccttcattctgttgatatgatgtatcacactaattgatttgcatatattgaaccattcttgcattcctgggttgaatcctacttggtcatgatgaataatctttttcttgtgttgccaaattcagtttggtagtagtttgttggggatttttgcattgatgttcatgagatatattggcccgtagttttgttgttgttttgtttgtttgtttgttttttgatgtatctttgactggtttaggtatcagggtaatactggcctcatagaatgggtttggaagtcttccctcctcctctattttttagtataatttgagtaggatttgtattagttcctctttaaatgtttggtagaattcagcagtgaagccatcatgtcccaggcttgttttgccagaagactttgtatttcaaacgagatcaaatgagaggtttgatcttgttacttgtcattagcctattcagactttggatttcttcatggtttaatattggtaggttgtacgtgtctaggaatttatctgtttcttctaggttttccaatttattgacatattgttgctcatagtagtctctaatgatcctttgaatttctgtggtattggttttaatgtctccttcttcatccctgattttatttatttgggtcttctctctttttcttagtctggctaaaggtttgtcaattttgttcgtcttttcaaaaaaaccaactttttgttttgttgaccttttatattgccttttctttttcaattttatttatttctgcctgattttaatttttttttctttactaattttgggtttggtttgctcttgcttttctagttctttagatgcatcattaggttatttatttgaagtttttctacttttttgatgtaggggcttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtatttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaaaggtttttactgagaaatctgctgccagacataatggagattctttatatgctatttttttcttttatcttgctgcttttaggatcctttctgtattctttacctttgggagtttgattattaaatgtcttgaagtagtcttatttaaattaaatctgcttggtgttctataccctttttgtacttgaatattgacatctttctccaggtttggaaagttttctattattatctctgtgaataacctttctatgctgatctcattctctacctcctctttaaggtcaataactcttagatttgcccttttgaagctattttctagatcttgttaggtttgctctattctttattattctttttccttttgtctcctctgtgtattttcaaataggcttgctaattcattcctctgcttgatcagttcttctgtttagagactgatgcattcttcagtttgtcagttgaatttttcagctccagaatttatgcttagttctttttaatgattttaatctctttgttaaatttatctgataggattctgaattccttcactgtattatcttggatttcattgaacttcttcaaaacagttcttttgaattctttgtctgaaaggtcacatatctccatcactctagaattggtcactggtaccttatttagttcatttggtgaggtcttgttttttctggacggtcttgatacttgtggatgttcattcatgtctgggcattgaagagttaggtatttattctaatcttcacaatctgggcttgtttatacctatcattcctctgaaggctttccaagtattcaaagggaattgagcatttgatctaagtctttggtcactgcagctatatgtgcattagggagtgccctaagcccagtaactctgagtcttgcagtcttgtataggtgctgcctcagtggtcttgggtaagatctgggagaattccttggattaccaggcagagtctcttgttcttttcccttactttcttccaaacaaatgcaatctctctctccatgctgagcttcttggagttagtggaggggtgatacaagcactcctgtgaccatcactgctgagattgtgctgtgtcacacctgaagccagaacagtactgggtcttgcccaagatgtattacaactatttcctgaattctgctgatgtttattcaagggccaaggactctttagtcagcagaagttgattcctgccagaaatggatctttcccttcagggcagtggatttccttctggcccagggtggatctagaaatgcagttcaggagctagggcctggaactgggggctgcaggagtctgcttgatgctttactgtactgtggctgagccgctacccaagttgcaagacaaagacctcttttttgctctcctttcctcaagcagaaggagtctctgcccagacaatcactgcctcaggcccatggcaactatagcttggctactgctgatgtttattcaaggcccaaggggtctttattcagcaggtggtgagttctgccaggtctgggtctctcctttcaatgcagtgggttcccttctggcccagggtgggttaaggaatgccctccaggagctaaggcctggaactgaggaaatgagaaatcctcttggtgctttagtttactgtggctctgctggtacccaagtcacaagatgaaatcctttttacacttccctttcctttcttcaagcaggagcctttccctgtggatactatagctgagaatgtgctgggtcacacatgaaaccagcacagtactgggtcttgccaaggcctgtgatgactgctgcctggctacagatggtgtttattcaaggcccaggggtgtttattcaaggcccaagggctcattagtcagcaggtagtgaattctgtgacactgggtcctttccttcagggtagagttcttttctggaccaggatgggtctagaaatgttgtctggaagctatggcctgaaatggggtctttaggactttgcttggtactttattttactgtgacggagctggtatccaaattgcaagacaaggtcctctttacacttccctcttcttacagaactgtgagccgcattgcctggagttggggaaggggtgatgcaagcactcccttggccactccagctggtgtatccctggaaagttctctattaataaagtttcctgggttgcatgcaccccagttccactggctgtaggcccagcagagcaccagtatttgtccaggaattgcagtccttgtggcctagactgcctttcaagtttatttaggaccccagaacactttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattctttgcttctttctcctttcttgccttcttttggattaatccctttaaagaattattccattttactactctagtagcttgctagttatatattattttataattatttaaaaagcaatactagaaattataacacacttttttttaatgtggtggtgtcttcattaaattagtactgtatcacttccaagcaatagaatagaccatacaacaagagtctcacttaactcccttagtggtggcttttgtgctatcatttttatgcttttgaaattctacatacatttaaaacctcacaagacattacttttattttaagctgtgaatattcatttagatttatctttctggagctcttcatttctttccctattttcttatttccatttgtttccatttatatatgtgtgtgtatatataataaaaaattatatgtgtctgtgtttccatttatatatatttatatatataaattcacatatattacataaatgtgtatatatataatacatacacactacatatataattttttaaagaactccctttagtgtttcttttggtgtttgtccgttgtgagaaattctctcaatgcttttgtctgaagatttctttgatgttgcctgtttatgagggatatattcattgacagggaatagaatctaagattggtagatattttctgccagcattttaaagatgtgatttcattgttttgtagctccttgatttctcttgtaacatcagctaagaatctttttgttgctcctttgaatgcaatgtgtatctttctctttgtctttggtcttcagcagtttgactataatgtgcctaggtatgtttatcttcatatttatcctgattggtattcatagagaagtttcaatctgtagcttggtgtcttttttctattttgaataattattgtccatctcctcttcaaatattgtttcttttcatttctttgaactctaaaatacacttgtgttaaggtattttcaccatgtctgatgtgcttatagtgctcttttttgtgtttttcatcttctttccctttatgtttcaatttagatactttctactgactgaacttccagttcacatattctctcagttgtcgtctaattgttattaaacacttctgttgggttcttaattttagttattggattttcatctgtaattttcatttgctttctttttatgtattccaatttttgataaaaattttacattgtcatttattttattcaacatatttatcatagttacattaaaaatcatttctgatgtcaatactgggattacctgttggatcatctaattcttttcttagttttccattgttggttcagtatcctggtatgccaaattatttttatttgaatggcacatattgtgtgtgaagaattgtagcaggtctgagtaatgtatcttcctccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaatttctgtctcttgatcactgtgatactgcagaaatacctgcttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatgtcctatgttgcaagacagaacatttcctaaagagaacagtcagctgtagatgtatcactcccctcaatgcatttcccttcctccagattttggcccctcagattgtggctgtcttggttgctccgatgacctcaagatctctttaaacttggaaatttgaaaaaattttagacttacagaaaaggaagttgcaaaactagtacagagagttcacatatacccttcactcgtctttccctaatgttaacaacttacatattacctttactattgatacttaaaattgtgttgccatgttctccaagctgataacaacagagcatgactgccaactggttgaaaggagaaaaaggaacctttcaaaagggtgacatttttggcacagggcttctcaaaatgtgttccttagaacaccagtccttggagattttcctattagacaacgtccacagcccagtaattgtaggaaatgccacatcttacatatatgtgcccctttggaaatccacagtgcccattaccattttattttatttattttttttgagatggagtcttgctctgtcacccaggctggagtgcagtggtgtgatttcaactcaccgcacctccacctcctgggttcaagtgattcttgtgcctcagcctcccgagtagctgggattacaggtgtgcaccaccatgcctggctaatttttgtatttttactagagatggggtttcaccatgttggccaggctggtctcaaactcctgacctcaagtgatctgcctgctgtggccttccaaagtgctgagattacagacatgagccactgtgcccggccctccattaccattttaaagcctctgaaaatgtttcagtaaagaaatctgcttaattttgttttccctgtgtttccaaatatatatagtcaagagctgtttttgtttttgtttgtttgtttgttttactttgcctggcccttaggtacatcccatggagctagtgttttgtggcacacatactggaaaatactattctggagcattttctaaaatcctaagttacaaattttgcttttttacattttctcttaggttccggctttcttgctgtttaatttcttgcttcatgaaagggaagaagatggagacgccaaggtttctttgaaaacagatatttgcacgagaaggcagccaaggctgtgttaacattcaccattaaaaacccaacacatctagacaaaacaccaaatgcaaaagcttcacgtttcccaaataaatttcttttataatttgtcactgctcggttgtaggctttgaaaatagttttcattttcctgttattgacaaaattaaagctgccaagaagtagatggtgaacaaggattttatctctgactgtagcaccaaggcaacctgagataggtctaatttgcagcataaatcttcttttccactgggggaagaacacacgagccacattgagtagccacccatttgtatttttgatttgcaacttctgtctagtgagccaaggtcaggtgcgatatttgtgatggggaagctgaataggtgagtgagggtagcttgtgtttgaagctgaagaaggtaattaagagggttttagaatgtaattttggcatttttccccactccacctcttcaaactatgtgtcccctgtcatcgcctaaccgatctgcctgtccaccttctggttcctctccagtccattatctcatggcccacttgactaatctttctgaaactcagatctgttcttatcactcacctttctaaaagtctccattgtccccagaattaagtttagccccatggtctggcccctgagtgtatgcctgtctgctccttttcatttaagcttctgttacccttgctgaattattatgctgtttcctgttatgttgtgtgcatctcttagaagctgcatatagctggattttttaaaatccactctagtattatttagtatgttgaatgtaatccaattgtgtagataatcattactgatctatttggactctctattttttaatcagccatttctttgcttatactattctttctgacagaaatgccacttttcttcttatctccctggtgaactccatatatcctactaggctttgttctggaactttcttggcaccttctcatttatataattgcttccttccatctgggttttaatggcaagttctgcatctctattacagaatagtattgatctcattgtggattgctgtttgtgtttctgctttccagtgggcctgtgagagtgactgatctttgcatctctagcaaattggcacagttggtagactttccaacctgagatattagatgtttcagaaattagattgaatgacgtggtgtcagtttgaaacattaaattgaggtgttctttgaaatgtatttaaggttatacaatgatttttgaatacagctttagctgcataccacagattttgatgtataatatttttattgttgttaaattttttggtaatttctattggggttttctttttaatctgttatttaggacagaattttaaaattttgtgctgatatacttatttttattgttggttcctaacttaattgcattatggttaaaaaaccccaaaacctaataaacatgctctatatggtattgattgactttgttacgtagtattaggttggtgcaaaagtaattgtggtttttgccactacttataatattttgcagcaacataatatatggtcagtttttgtaatgttctatctgtacttgcaaggaatatacattttttaaatttattggctgggggatataggtatatgtgcataatagttgaccaaggttattattttggtcattcagataatcaatatctttttcaattttttatcatgtttgatatgtcagttttctgatggagttgtgttaaatctcctgctgtaattgtgggtttatcagtttcactatttcagttttgctttatattttttggaggttatactaatagtggaaacaatatcattattataaaaattttggtggattgctccttttattattacattgagtctctattcctattaatgctttgccttaggaaggtatttcttaggtcaggcacagtggctcatatctgaaatcccagcactttaggaggtggaggcaggaggatcgcttgaaccttggagctcaagaccagcctgggcaacatagagaaaccccatctctacaaaaatacaaaaatgagccaggcatgatgctgtgcacctgtggtctcagctactcctgagatcacaccactgtactccagcctgggcaacaaagcgagaccctgtctcaaaaaaacaaaaaacaaagacaggtagctcttgtctgatattactgctgcaggctttattttgattagcattttcctagtatgtacattttgtcttttcagtctttctatgtgttgtgttttagttgtgactcttagaagatgtatatagctagattgttaaaattcactctattattatttagtatgttgaatttaatccaattatatagatgatcattactgatctatttagacttattactatctgattttgtggtttctgtttgccattccttcttcctccctctccctttattctcccttgttttcttttggattgaaaaatactggttttctaacagtgtgctggtatggatactatgttataacatgcatagttctatatgggtatcatagttttgtgtttttaggagttaccattagttatataacacagatacctgctgtgcattattgtaatgatgtctaaagttatacccatttctcacctcctcctgaacacacatgaatcttagtgtgcttgaaatatccactcaacacccttccccatttctgtgttattattgctgaaggttttaattttgcccttgtgtaaactcagacacattggtttttgcttgtttgtttgcctttactcaatggtaaatttaccaccatagtttctcaatttttattctcaccgttgtttcctatggtccatactttccctcttggttcggtttttatttccttgatgtaatactttagcatcactgttatttgagtctgtgaagtctgaatatgtctttattttctttctctcgctcttttttttttttttttttgagacagagtctcactttgtcactcaggctggagtgcggtggtgtgatctcagctcattgcaacctctgcctcccgagttcaagtgattcttccattctcccacctcagtcttctgagtggctgagattataggcacgtgccaccacatccagctgattttttttttgagacggaatttcactcttattgcccagactggagtgcaatggcgcgatcccggctcaccgcaatgtctacctcccgggttcaagcgattctcctgcctcagcctcctgagtagctgggattacaggcatgcgccaccacacccagctaattttgtgtttttagtagagacggggtttctccatgttggacaggctggtctcaaactcctgacctcatgtgatccaccacttcggcctcccaaactgttgggattacaggcatgagccactgcacccagccttgctcttaaacaacagtttagggagacagaaaattctagatttttattgcgccaccacacccggctaatttttgtatttttagtagagacagggtttcaccatgttggccaggctggttttgaacacctgacctcaggtgatccacccgcctcaacctcccaaagtgctgggattacaggcatgatctgtaatcccgtgcctagccgatttcttcttaacactttgatgccattccttcattgtccctggcatctgctgttgcagaagagaaatctgctgtcaatcttattgttgctttggatgttttttcccctgcgatagttttaggattgtttatttttgaggttttgctgcgtctgggtgtgaattaatattcatcttgcatggtacttgagtgtgcttccaaactgtagactcctattttccttcaattacagaagataaaagagccattttacttgtaaatattgattctcctatattctgttgtttttttctggagtgcctgttggatatatcttggaatctctcacttatccttcatatctattaactgatatttccttaaaaaaactcttcatctctgtttattttatgttctttaagttccttaatattttccagcttaccagttctttcctgattgcgcccaggctggagtttgtcccatctattgggtttttcatttttatgactatataatactttttgtttctaatgttttatgtctatcttgaaaatttcttcccttttgtataattgtttgctcttcattaatagaagttattcctttatctatcattttaataatatcctaaacacacattaaaaagtctatattgtttcataaaaccgttttctctagaagtgaattcatgttatgttatgtgattttgtcggctctctttcttggtgttatattttattcatgtgccttggaatttagatctaggatgaattttaattccaacttcttgtgctcacttctctctagtgattgtggcttcttccacccagcttcccaaggccccagtacaaaaccgtggtttctgttctgtggtgatattggggctatctggatccagtcacagagctggagggggtggggatgtgacttgactgattctttgttcttcagtctccttgggcctgcagattgccacatgtggtagcatcagacaggggtttacatctgaattttttttcccagcctcatttgcttttccatccccagctgtaagcagaacttgaacccagactctggtctcatggagcacttttagatccttttgtactcagcaggaaccagactgctggctgtcatagcctgtgtgcaggcaagaagcccagcaggcccgaggcttcaaccttgttcatcatgttgtgtttctgttcattttcagattcacaaaaatgtttattctgtttttgagcattgcttatctttctggttttctttttttgatatttaatttatccttgctatgtattcaaggcataaagagtgcatattttgatatttaatctatccttgatttgtattcagagcatagggagtgcatcggagttgaatttgaatagtcatcttcaccagaaatagaagcttgagtatttatatttagcttccagcacctagaggaaataaccttgtaaccttggaaggaggccaggtgccctgtaggaatcacgtctatctttttttatctttctatcccaagtaccagtcatgtccctgcacatagtagatgctcaacaaacaatatttgttcattgactgacctctgaaatataattacgtggcctaaacagctaatgctatatgtgtatttatacttaatgtatcaaaacagtaaacaccactgggaaattcaggaaaagcagaaacgaatgatcatgactcttaacctgtgactcctgttgaaaatgatcccatatgttgtcttttcaaacaagatatattcatgtcactagtttctgttcttgaaagtagaaacactactccttctattagacattttggtttctgaaaatagaacaagtaaaacctgaacaagtgcgaactcgttcggattaaagggatttcgggtccaactctccaagccaaagggattttcaaatggttattttaaaacgtggatctacatgtgggcttctgtggtttcaatagtcacaggaaatgcaggccactgtatcagtcagcttttgctatataacacaccatccgaaaacacagcgacttaagacaaaaaaaaaagttcatttagtttatgattctgtgggtcagcaatttgggctgggagcactgggtgggtggatgtgctggtgtggttgatcgctgctgggctcactcacctgttgccggtcagctgccaggtgagctgagggcttgatggcccgaggttgctcaggtgggatggctgatctctgatccacgtggtctttcattctccaacaaggcagcccagacttggtcaggtggaagcagtcacagcggacctgacagagtgagcagaagtatctgtagagcctctttgtgagtactgatttggaatttatagctatacagtgtggtttacactcttctattggccaaagcaagtcgaagcgtggaaaaatagacttcttaatgagaggagctgcaaagcctgtggccacttttgtactctaccatggcaacaaaacgtggaggtgccactccccaccccaggagagattgtgtaactttccttagatcctcaggctattacctccaaagttgagaaccaatatgttggatgatttcactactgaacaacaacaatgaaaatgtttaggagagttaactgatggacacatctgttaaaacactgcttggtgtgtggaaatgaaatttttcattttttctattggaagttatgccttgtatcaagacattaggttaattctctctgacttctgtactcagcctgaaaagtaaggattcttgttcagtgtaccagataacttctattatgtggcaaaccactccaaaattcagtggtttaaagcaataccgtttattggactcctgttcccatgcctcagcagatggggctgatctcagctggggtctctcacgttactgcagtcacctgcaggtcagctgggtggctctgattctggggatggactggttgtaccttggtgggtgtctgggccacttgtttctctccattcagttaatttgcctgggcttgcttgttcacagggtagcaacagtgtttctagagagtgagtagaagcacacaagatctcttcctgcctagctaggcttgtttctgtggggtcaaaacaagtcacaagcccagcccagattcactaggtgggaagatagactccaactctagctcggaggaactgtaaagacgcaggacagggaggatggagaaccctggccattttgtagtcttctgtatctgttgtcttcaagaaattccttctcacacttcgaatttaagtaaaatactatctccacttatatttttcctattaaatagtaataccgcatgtgtaatagtagtagtaactacacttgtatttaaaacaacctgccatcttttcacctttaattgatggcacctcccttactgtggatttgcatattcatattactattttaagggcgtagattatgttaatgtgttttgctaaagaaaatgattgaacttattttcttcttccaatttgtcttcctcgttctttaatccaaccctactggtgccagacttgcttttctaaagggtttctctgtgtttgatgaagactctttagggatctctcactcgtactctttagcttggcatttgagaatccctgtgctctgggcgttgcgtaactttcagattttattttcctccattcttccttgtgcactagttttcacagttaaacacaatttattgctgtttttttttcttagcacattggccatacacaaattgtcctcagctcttgggcaacatttttggttgttacaaccgtgtgtgtgtgtgtgtgtatatgtgtgtgtgtgtccatgcttgtagtactggcctttagcaagcagagaccagggttgctgttaaacatcttgcagtgcacaggacagcccccacaacagataattatctgctacaaatatcaataaagccgaggctgagaaaacctgtcctatccattcctgcccctggctcttttttccatgcctcatcccagaaggcctttccttcagtgccgcccgatgaaatgttctctatccttaaaatgccagctcaaatgccacatcttctaggaaacacatcccgcatgaacctactcccagtgccgtgggctctcaaagtccattctgtgcatcactgaagtgactaccacttagttcatttacagtaatttgtctctagtactattattttttaatggttcttattgttcttttcttgttttttaattgaatgtttgtgtgttgactctttgggtgaactgtgtgttccttgatgacaagtatctctcttgtctatgtcctacagcacttaccatgtgttttacacatagtaggtgcataataaatatctgttgactgcatgagaaatgtatgtcttcctgtgcctttagatatggttaccccttccaacaattttcttaaaggagttagttcaaaaaatccaacaagttgaatccaagtttttttgtttctgtttttaataatttaggtaaaaaactgtgacaagaaatcattgtacaatgcaattatttatgtttatttctgcagctatttagtgaaaaaataagtggtgctgaaggaactaaactagacgatgaatttcttgacatggaaagggtaagagcattttaatatgtaaattgattagaaactgactttcattgtgatatgagatatactgctattgtaaaggatattcgagtggaaatctaggatgtttaaatataggtgtggattatgcaatctacaaggcagtactttcccacgtcccagcccaaatcagatcctccccctgtagccacatgcagtttgggcaggtcgagtaatgagatcgatgtggctaactggtaccctctagtggccagaagtcagaatgtgcaaaagatgggcaatcttggcagttactgcaaggccaaagtaattggtagtatatgttttggagaatcaaaatgtatttctgggacaagattttttgaaatgcagaatgatttatttaccgtgtggaagacttgggctctgctcccatgtgttgcaggagctgcatagcaagtaacttttatcctggttctgcctgtagaaccagagtgtgaacttggataagtgaattcatctttttgaactgatacagagatgacaagtgtgccctgcttgtctcacatggattttgtgagaattatgcaaacattaacgtatttgaaataacttacaaaaaatatgacgggcttgagacagaaatgattgtaacatgctccaaagaaaaatggtatcatctctgtcccttaacatgtttcccagtcagctgtgtggagttgctcaggtggaggcagaactagaaccaccagtattaacaacatactgtttctttgctcattgtctgggccctttaaacatagccttgttttaataattagaccccccaccccagaggagagagggaggaaatgaagcaaggcatccaccctcaggtgtaacatcaaggctgcagatacagtaggtagcagagatgtcagcaggtgctggggaaggaagtccagccccaggctgcgcactgcctgggagagtatctccccaggataccttggctctggccagctcatcttccagggagttctctgttttctggatgagaactattaaatgtctagaaatgttaatgccttgagggagaaaagcttattttgtttttgcttttgaaagaaaacttaatttctgaaccttaaaaccatggaaacatgttcacaccattgacataccttaaattacttaaaaaaaactcttaatatacaaataggtgatgtatagctttgttactaacaaaatgattcagttgaaatgttaaatttaaaagcatttttccagagttttagttttggttgatggattgagatccttcttgcttacctccttttacctccaaaaaccccagtgagttacagaagaaatataaagtctattatctgttttattacagcagtgaaaagcatggaaacatataatacatgaccagaagttttaaaactttccagaagagatgcattagatggtattagacccacctaataaatgatacagaaatgagaaagtaatgggaaaaaatattctataattaatgctaaccatataaaaatagaggaacaatagtaaaatcaaaataaaatttgatgcaagagaagcactaaattaaaaaagctttttaattataaaaagatacagtcaatgtagtctatcaggaaattataatagttatgaaccattctgcactacataacatagcatctgaatttttaaggtagaaactgtcagaaatacatagacagttgataaaaatagaagtagacttcacatacctctctcataaaataatagattaaactgacaataatcaataggctcatggaggatttgcataaaatatgattaataactttgattataaataaatatagatatctgcattccccaaatggagaatgtgcatatttttcaaattcctttggaacaaatatggttatcaattatgtactaggttatagaaaaaaaaactcgataaatttcccaaagtgattccatagaacataagaattataagggaaagtagagcttctaaattctggatgtttggaaatttaaaaatatgtaaaaataattcttagtttaaagaggaaatggaaagtaaaatgacattatttaggcatgagtgacaattctgtatgtcaaaacctgtgatatgtggctaaactgtaaatgtatttaaagaaaataaatgttgggagaaaatgaataaatcatgcaatccaagaagctaggaaaataacagcaaattaaatcactctaggtagaaggtagaaatcaatatggataaaaaaagagattaataaaatagaaaacaataaccacaaaagatcgaaacaatgaagccaagagctttagaaaagctgtaagacaacaaacctctaccaagtgaggccaagagggagaaaaaggaaaaacacaaacaaattacataaagaagaagaaagaggatatgcccactgatagcattttttaaagagaatgctgtaaataagtgtcagaaatgagagctgctagcagctctctcactcagggactgggcctaagggagtcagtggcacaggccttgggacacctcatgggcagggtgccagcattaaacagaaattccagacttaactaaccaagatgctgtcataccaggttgacttcacaaaaaataatttttaccattctgcttccctctatttttcttaatggtttggcaggatatttgcatagcatttggttgacttgaacagacacacacacacaacacacacacacacacacacacacacacacacacacacacacacacacacactatagtgtccctagttattctaggagggagattttgtttttaagctacatgagtttttgttgttgtttttttgttttgttttgaatgctcatcttgactccacattagccaatatgtttactcttcaatttgtaaagggtttatttctagttttgatgcttgggctggtgtggaggcagctccagtatgtgcatgtcagggcctacaaggtacctgcaagtttttggtcatttgtttcttgggcttttttgtttcaaaagatataaaaaagatctgaagtagaaaatatccccattctaattcctctcatcatcatctttcagagatgactcttagctttgtggtggcttttcatgtccaaaaagggttgtatatatcaaagggagcactctaagttatattttaattaatatctaatttgttacattataaatctaaaatcctcatttttcttaagctttaaactgaacttatgaatcttgtttccaaatttagtaattttgctatatgatgaaaatcattatagttaattttcatttgaggttgcattaattaacacataagcttaacagattcaatccttaaatatttaccaccagttatataattaagcaaattcccttagacatttcaagctataatcacaaaggcaaggtacaggactccctcaaactttacataaaatctattaacagcattttcctaagcccttacatttcttgtgactaataagacatatttagttaatcagattctcttaaacatttcaacaatcttggcaaatagctgaacataccaaagagagctcaaagtcacaaaacttgttactaggccaaacgcacactcacatgcccacttgcacacacagcacacaagtatcagtaatataggtttgactccttttttatcatttctgtactgtcttttaaaactttcctggggctccagattaatttatttagcccaaattaatgtatttacctaaggggaacaaatacgatttcaggctggataagattgcttggttgcaaacttgtgaccctggcaggatcatagttttctaaattacaaaaatgatttgtcttctattataaatcattctgcagcttgcttgctttctatgtatgtactttgaatgtcgatcttccttattttttttccttatgattaaagagtattcctttacttggatgtttcataatttatccatcagtctcctgttgatttccattttcaatattacataaaatggcctaacaaacatgtttttccttcactgcaatttgctcgtgtgtttctaaaaggacaaatccttagaagtataatagctggtttattaatatgcccattaataagcacttctcccttgatctccaaaaacgtatcattttgcattcctgttgtgtgttactccacacccatataatacctgatattgagtataactgattttaaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcaccatattggccagcctggtcttgaactgctgacctcaggtgatccacctgcctcagcctcccagagtgctgggattacaggtgtgtcccaccgtgcccagccttttccttctttcttgtttgtttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgttgtctgtatgttagtcgttttatagtctgatttttttaggttgatatttttaatcatgtatatagtatgaagactcactttactatcagcttgccaaattttaacaaaaaaaagaaaaaattgaaattatgatgggatttgaatgaattttgcatgttaatttgggaagaatgcatatctttacaaaattgagttttcccatctaagaatgtggtttttcaaataggtgttgtgaatttctcataatagttattcttcattattgcatttttattgcttttatgaatgagatctttttcttttgggctactgatggtataaataaagctattgcaacttgcattttaactttattgtttattcccatattaactctctggttaactaacaaccagaaagtccaggaatggttttgcagaaggaaagattcagtcttaaccagaaagggttaactttcagggaacgtttggggaaaactttgatgttaacatcttctgaccatagcacaaatgaatgtgtttattgtattataatataatactaatgattatgattcttttagtgttgattactgaggcagttgctaatatgaatcattactgtggcatccttatataagtatagaaattcaagttcacctagcagataaggagagtttggttcatatctagtgttagttttgagagacttccaagtatatctaataatctagtggagcataataacttttccagattttctaaatattaccttaatattcattttaatgtttaaagggaaagtaaagttctccaacatcacttgaaggaaatgatgttccaaaaatcagaaagtgagaaaatatcacctctcccaaaaatgttgaaaacgttcatttggattaaaatcatcataatcgtgttagaagaattaaattaatgaaaattcctcctctatttgctcttttgtgattttattgagtttgtcatttactaactttttttaaattttgcttttaagaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacctaaccatttgaaaattgagaaagtaaaaatttaagaatataaattttatcaggtgtatccaggcaggtctaaagttctttacaattgtattgatgataatagctttgaaaaccataaaaatatatcttctcctccctggccacatcagtgattgaaatcagccacacaaatttcttttcctgatatatcagtcaacaaatatttaatatgtgctttctctgcactagaggatttcggggtgctggagtacactatgaaatcagacagatacttcaccctcaaccagctgactcttgaatgggataaggaagtgttggccaacaataaaagtgtcaccactggctagaggtctctggttattcctagagaagaggcagccctagcaacctcttatccagtttaatggctctcacccacatacctgctgcatcccacatccccctccaacagtgggaaagatgggcagagagagagagagagagagtgtgtgtgtgtgtgtgtgtgtgtgtgtgtgtgtgtgtgtgtagtgtgtgagagtgaagcctttgggcttggggacctggaggataaatgctttgaggataaatgtgaggttcaaaagtccggcactggccaggcacaatggcttatgcctgtaatcccagcactttgggaggccaaggcatgatgattgcttgaagccaagagttcaagaccagcctgggcaatgtagcaagactctatgtctacaaaacattttcaaaattagccaggtgtggtaacacgtctgtagtcctatttttactcaggaggctgaggtgggaggatcgcttgaacccatgagtttgtggccacagtgagccatgatcataccactgcactacagcctgggcaacagttgttgtttcaaaacaacaacaaaaaaggctggcactgtgaatgtcaggtgaatgtgagtggcactcacagctggcacgggaatgtcactactcacagtgcattctattgctggagatgcagaattaggctcaacccagaccgatggaatcactctacattttaacaagatccttgggttatttacatacacattaaagttttggaggcattgatttaaaatacattaaaaatagtacaaaattattaaagtaggaaaaaaagtgtatctcttgactatctaaaagtatctcaaataccacaaactagtatgtgattcactctctcacctacaggatgaaatctcaaatccttagcttggtgttcaattcatagtcacattttcccatagctatctcccactttgtcctgtattaatagcattttaggtcaaaccagcctactccttgtccactgattatgccacagtattccctcttctacacgttactgacaccattctctgtactttttagggcatctttccatctttcttcagcatattgccgcctttcccttgccctgcaccacactggactttattttcataattatgtcctgtatattctgcctcccagtaactagactttgagctccttgagggcaaagcctgtctctggagtcccagtaatgagcacagtgtgttgttgcacagggcccagtgcaacaatgagtaaatactcattgcctgagtcagaggaaggaaaggaaggtaagacgcagtgatgcgcatcacctccctagggagcagaggctgagctgcaccttgggaccagccacacaaggctagtgttcactaggggtggggtggtctgtcccctcctatgattctgcctcctaaacagcagcacctgcctgccataatactgaaaatcattaggctcaatcagtccttgggagcagagtgtgtgtgtgtgtgcgtgcgcgcgcatgtggtgtgtgttaatgaccagttggttgtttgaaatatcctcctcggcaattctatttttgtttacatttaaacaaacaaacaaaaagcatgtcagtgtcacacaggtgtcagtgtctgacttcacgtgtcagcaactgcaagctttccaaagggtctcactcgaggggtggtgctcaggaaagcctggtcactattatttcaagtcagcaatgtgccccatcatttctttttttttttctttctttctttctttcttttttttttttttgagacaaagtctcgctcttgtcccccaggctagagtgcaatggcgcgatcttggctcactgcaacctccgcctcccgggttcaagcaattctcctgcctcagcctcccgagtagctaggattacaggcatgtgccaccacgcccagctaattttttgtatttttagtagagacagggtttctccatgttggtcaggctggtcttgaactcctggcctcaggtgatctgccggcctcggcctcccaaagtgttgggattacaggtgtgagccactgcgcccagccgatgtgcaccatcatttctatggttcatcgtggctgcggaacagtgcacttagcacccaccttggtaaagaacctagaaaattacctgagaaaattaaatagttcacacacaattgtttcaggcctcaggtctctggcattttgtttaaggtgacctcagttttggcagctgcgtttattaaattctatgtacctgtcactccaccttgtaactttaaagaattacaaatgacaatgtttttaagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggtgagttattcagagatcagctgggggagctgagaactcctccagtatggttttaggttatacacaaacccttcagtctaacaacctttgttatttttccatattaccaaagtaatacatgttaattgcaggaggtttagaaaacataggtaagtaaaataaagaaaaatgctaacatcacccataatcccatatccaccgataggcccaattaaactctgttgtgtatcttttttttttttttttttttagacaaagtctatgcccaggctggagtgcagtggcgcgatcttggctcactgcagcctccacctcccaggttcaaacgattctcgtgccttagcctcccgagtagctggattacaggctcaagccaccatgcctgactaatgttttgtattttaaatagagacagggtttcgccattttggccaggctggttttgaactcctgacctcaagtgatccgcctgcctcggcctcccaaactgctgggattacaggagtgagccactgcacttggcttgttgtgtatcttttatgccttgtttattcttatatgtattcatatgtacttttaaaaactacagtaaggctatagtacatatactctttggtaacactgactatataatgatccatatcgtaaaataattaatcttccatgatattgtttttaatggctacataatattccatgtatcatagtttgttcagtcaatcccatttactaaataaatgtttctttatgtaaaaacattttacatagcatttacaataaccattttcataggtaaatctttggggatatccaaaattatattctttgacataatttagataacatgtctagtataaaattgctgagtcaagagtatgcttatttttcaggttttgaaagcatattcccaacctacccttcagaagggttacactcatttgacactgttgccaggagtgagtgagggtatatttctctacatagttcctaaccctagagattatctttttagtttacttttaaataactgatcatttgatatgtagtatacaaaaatgatatctcattgctgttttaactccatcttttggatcacgtgtgaggtggaatttttatttgtgtttgtcattgtttttgtgaattgtgtgtttgtgtccttagcctgcttttgcatcaggaggtccattttttcccccctgtctcatgagctctttaaatggtcaggatatttgctcattggctgtcttgtatgttgatgaagctttgtcccaggtaagcatttgccttcagaccttgtatatgaaggtcatttcaatggagagagatttttattttttatttactgaagctctttagtcttcctatatggtttctagctttttggaatcatgtttagaaaatctttttcatcccactccctggcaaatgatataaacgtttatttatacttgtttttgaatcctgtattttcttttattgcctttaaatttccaagctcctgcatttattggagctacagtgcaatagggttctaattttgttttctaacaaataaatagcttgtttcagtactgttgaaaagtccaactttctcctgatgatttgaaatgattcttttattataggctaaattattatacattaaatttgtttatggtctttctcttccgtttcttgatctgtatcctgttttgattcagtgtcatattgttttaagtattgaagttttaaaacatactttaatatattatttactaaaaatttaggtattgtattgcaaaaagttcacagacacacttactggttttatttttccaggtgaaacttaagtcccttttatttaaaaaagtcattaaattttgattgagattcatttaaattaatacattaaattgaggatgaattggatttaatatattaagtattcccaaagaatttggcatatttgctattcatatagtggtaacaaggcaggagatggaagagatggaagttgagaaatcaaatatttggccacagtaatcattctaggaaattggaggaaatatcttttgaaaaaaatgttaaaactcaagcattaaaacacgaattaattagtgacaaagggtaatattatccctcagagcagtataatgtgaattttattttattctaagggccaatggggacaagatggcctatttcttactctgaaggcacatcagtgaagggagcaggtgaaactgccaggcaggccttgaaatccaaggacactcctgccgtgcatctggccttggcgacagccagacaatttggtagcttcccaggtgctcggcaaccgaaaaaaacttgggatgaggaagagagctgatgtcagcagggcatcaggaacagatggatttctgctcttccaaggaagaggctgtgccgttggatgttttcttttggggggccacatactgggacctcctacagtacagaaacctcagtgggtggaggctgagccccacacccgtggaattcgacagcgccagtctcaggcaaggagagggaatgttgattccagggaggtggcggcccatgttcagagcatcatctttggagtctacagtgtatttgaaaatgtttctgtcaaggcgaaatgagctgacattgtgagacactggcactggtggcagaggggctgtgtagggggtcaggcaataccatttctcaccatttgggcaggaaagagtccacaggctaggaagggacatttcgtcttcatttaggaattatttagacacactttggagagttgagctaaggaaatgtagcttccaaggaggaatgaagctaccactgggtccgtatggagtcctgggaagccttagtttagagtaacggttcctacttctgttttgcaaggtcctctttagtatctttctgttttttttttaagggaggtgaggcacatgttgccatctctattttacaggtaattaagttgtccatgccctcacctggtgggtgaaacaactcaaaggtcagacttaggctgggctttacggtcttcttcaagcctagaaatggagcaacccaatctccatctttttacaagatcaatttggaaaaacccaaatataggaaaaatagttcattctagtgcagcatttcccagggatgttttctagagaccctgcaaccctcattgtacagagaactagagggcacctggtttgcagtaatctggcaaattactgccgattaaccggactgagatagcacactgtaatccaggaaaaactacctgccactacccgagccaggaaggctggcctgggctccaacgcaccagcagacccccaccccaccctgctgacaggatgtcccatgtgacactggcaggctttctttgacatcagagagggcagggaggcttagaaccttctagaaggatacggggagtagccttgagaagatcccacggctagaagctgagatgttttgttggtttatttctattgtaatttttactggttaacacttagccccatgagtgaatcctttcattgtttacaaagagattttattctcaagcttctaaggaaccctccgtgccagtttcccaaattaccagttttttagaaaggatctttatccccatctagtggtccaaatggtaagtacttcggtctgctagcctcagttgtattttctgtagtggtgaaagtgcagaccatagagaggaaaatacagaaaataggaagccttgctttttctttttcattctgatccaggattcagaggtcccggagcaaggaccttgctacaccatcatccacacacttttggtaaagaatgaaataaatagcactgttaacctggagtagtgttcccaaagaaccttttgtatttatgttttctattcaaggcaatgcattgatagaagttggtgaatccatgaagctaatggctgaggtgaaagactctcttgatattaatgtaaagcaaacttttattgatccacttcagttactacaagataaagatttaaaagagatcggggtaagtcttccagggtataaatatacctgttgctacataagatgatgtttatatttaaaatcactagaacgtttcagcagactgaaagcatcatcttatgatgcttgtgggtagggtaaaaatgactcagttctattttcctgggctcactgggaaagagtgccaggatccattagtcctatctgccctggagatgaagcaggataatgggagggaatgtaagccatgttctttcagctggaaattctgtatttagttgaagccagctctaagccaggctaaacaaagtaattacataactttatagtggatttcttattatcaaaatcgtaccatagttgcatgttttgatgcgttgccctggtggtcattattttccattacttctcaagaagatcaatacctagaaattgaatttttcatttggaaaactgttaaaaatggcgtgcatgggaattttcaggtacctggagataattgcatgccacttgcatggtggcatttttgtagatgtgcaaaaacagccccaagacttctaccccaccagtgacttccactctggaggtacaagcaccgtcttatggatatgtacagaagatgttcctccaggtgccttcagcatgatctcagcttggaggtcatttgagccttgggcatatcctgttttcccttcttcagacctattgattctcaaagtgtggtccctggaccagcaacatcagcatcacttgtgagaaatgcaaattcttgggccccatcccttatctcctgaatcagaaatcttatgggtgaagcccagcaagtctgtgttttataaagtcctccaggtgattctgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattcatccatcaactgtgtatagcctgctctgccctgctacagtggtggtgggcactggccatatgtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagagggccagggctgtgagagcaggcaggctcggggacctcggttgtgtgatatggccaggggatagggtgtgtaggggtgggggtgcaatgaagggaggaaaggctgagagtcacggaaagccctggatgcctgtccaggcaatgtatttagaatttctgctgaaagcaaagggtatgagggagaattcaggaagtttgagtgagaaatgaaagcatccattcaggagctccctaaacatcccattccccacctgcacaccccttggccccgacactcataccatcctcttcttccatctcaggggaaacatgtccctgttgctctcaagccagtcctcctctgggccgcagggtctgtcacctctcacctcctcagggccgttgtgacatccatcgtcctctctggtgtatcttcattctttccctttctgtctgttggcttcttcctgttaacatttacacacagcacagctgcccttgacccctggtgtcacatctcactccctcctgtccattctccagcccacagccagggcaccctttctgagctgcaaaccttcctggctgcccactgacagtggggtgaagatatagaccctcagcccttcacagcctggcccctcctttcctctgtggccttattgccaccccttccccacatgaactctgcccagcctcactgaattatttccagctccctggtgacgttttgctttgtgctttctcgctatttgctgtctttgtcctttcaccccttctcctggctgtcacctcacccctcagctcggatgtgctttcctttgggaagctgtttgttctttcgctagacttcgtggggtatcccttctgtgcctctgtgtcatgagcaccgttgcttaccttttgctcatgttgggcagtccattcctcggggtgagtgatcgtggtttgttccttgtagtcacaagcctcccacgtggtttgtgctcacacattattttatttttttaattttaatttttgtgggtacgtagtaggtgtatatgttggtggggtacaggagatgtttttgcaaattatttttgaatggttgattctagagaagtgacagtctgggttctggggatgccaaaacatctcccccaaatgcacagttgtaaaaccaaatgcctcctttgctgacatatagcaagttttatttcttcttgtgctgtcatcatggaggaaggtcatatgaaaagtcagcattgctcctccacctggccaaccacagacacatatgtggtcctgagtagtaagtgggtgaaatgtgtaaaacacacttattctgaaatgttgcagttctctatgcaacaaaatagttttctaaatgccatcttgttactcagctgctgtttgatacagaactgtaaatctaaacttaaattatgtggatgatggaaagttaagagtccaaggtttaggaagcctttcatagtctcagctatgctctgtgtcgctcagaaatcaggggtcaggggcctgttcatttgacatacggctgactttcaggtgttcatgtagaggtacagagggattagggaccagcccaaagtcacagagcaaagagagagatgtttctgactctctgggtcttgtgtgctcttttcactgagtcatggaagttagaagcagtgcttcctgctaaaatgaatagtgcgagctatccccatgcttcagtgggatgatcagtttctacatacactttcgatgcctggtatctgatttccgaggattatagccataaactctccagggacccctcccttgtcctgtatagctatcccactcagcactgtttctgacacggggtctctctgcttggacacaaactgtgatgggaaacctactgctacgcaaggcagcctgttccatgagtggacagttctaactgttatattttgttaaagcggttataatattgtttagaaattttactgtttcagaggttgtctgtgaatctctctcctttgcattcattaacagcgttttacgcaacttatttcttgattgtttgggaactttacggagatccgttaatattctaagggattgtagaagtttgtgattttatagtctactacttagtcaggagttgacaatagtaccaaaagaaatgttcctactgtgttttgtttggttaacctggttagaaattatctggacattaagaaggctgaagtgagggatcgtataaagaacgttggaaaataatatctgagcatggctactgcatcattacattccataaagacactcattcattctatcaccgatctgtccattcattcattcattccacaaatattcctggagcacctgaagtgaggggagcctccatcaggtgctgaggtgctcccaacagcagtgtaaggtgggttcctgccctctggaatctaggccgagaaaaagcaatgaccattttaatagaaataattttttgtgccaggttttgaatgtagcacctctctgagggactccattctctttttttagcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtaagtatttaaaccaaataggagattttaatgtaaatgaatgaaacattgaatatatgactatgatcggcatgttgaaaaactctaaagcaggagtgtccaatcttttggcttccctgggccacacataaaatacactaatactaataatagctgatgagcttaaaaaaaaaatcataattttttttttttttgagacgctgtctcgctctgtcaccaggctggagtgcagtgtctcggctcactacaacctccgtctccttggttcaagtgattctcatgcctcagccttctgagtagctaggattacagccacgcaccaccacactcggctaatttttgtatttttagtagagatagggtttcaccatgttggccaggagggtctcgatctcctgatctcatgatctgcctgcctgggcctctcaaagtgctgggattaaaggtgtgagccaccacccccgtccaatctcataatgttttaagaaagtttatgagtttgtgttgggccacattcagagccatcctgggccacatgtggcttgtgggccacaggttggacaaacttgctctaaagccttagttgttatgcaagtttctagaattttctcctatctcctgcctgagagattgattgcttcagacatccagcaagccctgactcacatctttttttggagacagggtctcactctgttgcccaggctggagtgcagtggcacgattgtgactcactgcagcctcgacctcccaggctcaagcgatcttcccacctcagcctcctggatagctgggatcacaggcatgccaccaaaccctgataattttttgtcaagatgggagtttcgccatgttgcccaggctgatcatgaacccttgggctcaagccacctacccgactcagcctcccaaagtgctgggattacaggtgtgagccaccacgccagcccctgactcaatatcttaaatcttgaggagtcctgtttatcccaggattgcttcagaggttgtctctgaagattgctaagtagactggcttttgtatgtgaggccataggatttatggtttcacaggagaatgaaaagtcgaggtcatgtagtaatttgccattttgctgagactgaaaagtacttggcaaggcagatggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgcagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattgagcaccctttatttaccatggtgatgtatggaggaattatgtccaatactaacaagacattcatcctggagaatttattctcccaactggaaatgccaatttgaaatttcccatgcccattaaaccactgaggcctgaaaagtacactctactgtgtttcttcttttaatttttttttttttttacattttttttgggaaataggaggaggtgtgacagtttggtatctctgtttttctttaaatgtataaatttcctcttgaaattgtccccaagcaacagcgattttgttttgtttcagattgccgtattgttttgaagtctttagaaaatgtatttgaagtgtgacatgtatcagatactccttgttgggccatatggaatgttgccctgctggctccaggcccattcatggcttaaactctgagattgtgtcttgtgtgtcagatgcgccgtctgacccatttgttccattcactgccttcatgcgggaaccacaatgatgggtttttgcgaagtgctccatgagggaagcctgtctgagccacgccggccttagcagttgacccaagagacctcagttttccccctcagtatcagtcaaaagtcaaaaaggatcccttcattataaaagctcaatcatttgtccatgttttgacagtaacacgtattctgcctgtcacaaatgggttaagtcctcccaccctgccccagcagaagtaagagctggttcctagcccaagctccgcaggggctctggtgctggccttgctccggcctggttgcagtgtttcctccaaggcttcctgtgggaaattgacctgcaggtgagtggaggtttcccctgttcagctctggggagtcagggctgctccctcagcctggatcctggggtcttcaccttcacaaggaggggttgtctggcttctacttctgccattgaggtgggaggagaccaacgttatgaaacggagatgggccgcccaggctgcccgggaactaggctcttccctccttcctgcttcctgcttcctgccatctgtagctgcaatggctgctaggtgtgctctggctgctgcttcttgcggtaatggtggtgatcgtgataatgataaagacagtggtgataatgatgatgacaatgacaagagctaccattcactgacaccccatgataaagaggctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcagaaactaaagatggctgggacctgttctaatcgccatgtcaaacacagtgggtctttgggtgctgctgcctgatggattggacggtgtttctacctgatctggtacctgctggagacaaggtgcacaaactgtcaaatgagtggctgcaagggaagcctggtggcaggcagcagaggccctgacacttcctccagacacaagtgggacatgcttctgttactgtggtgggaagtttggggatgtcagtcacagccattcaccctttgggttctgaccaatggaggaagtgacaaaaaagccggattggaatcaagggacatctctttaactgatgagaatgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacgctgaagctgggtgagtgggagccttgctggccccaaccctgcagagccagtgactgaggcagagcaacccatcctactaactagggagcacccccaacctcatccacaagaggaggaagaggagggcctggcgagaggacttagaagcattcgctccaaagagaaagtgaataagcagagaagcaaatgaagggaaatcctctgagatgggtgtgcttggtgctcttgtgctacctgtccatctctgtttggcactgacaattcaaagaccaaaatctcaccctgggggaagagctggtgccttctccagccctcatgtctcatcatcctggctaagacgcaataaaagcttcaccggggaatgcctcaaaagaaactgtttgccaaaactctgactgatgtgaggagaaccctgactggagttaacagacttggtctttcctgggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttcggccccacactgtagcctttggttgtcttgtgaatgggagctggattagagacattgagcatctcttcacatcttgcctgaggctgagcagtgtcgttattctataggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatcttgggaacactatatcacccataggcttgttaacacactgtcacctcttctgtctttgcagagaagtttattcctcattattcctcacaacttactagtagcaaatgtaggtctttgacattagcagaaatcagagatattccatagaagatgcctatttcagtccagtgagtccaggcacctgcagtactggctgtcttggtatacattcaccagctacgggatcctccttccattcatgggttcccaagaccagtggaattactagattccagattcctgaggtctttccattggtctagagtagcattttccaaaatccattccatgggatgttagtgtgttttgcattaataatgtctctgtggtcacataagtttgggaaaccctgggttaaataaaactaaacagtttctttatcacaagacttttcagagtctttatttgacagtatgaaagattaatctctaagcggttcctaacagaaaatacagttggcagtttaccaaacttatttgaccgcagaattccgtcacattattatattattactaatgtttcaggactgtaatgtgtggaataagatgcattaggaagtattgaacttgtagaaagcatacccagcaaggcgtgagatacctgaattctgtttctgattttgtttctgctaagcctctgggaaaatcatttcacctgactggtatcaggcaaattaacaactgcatttgagaaattctttagaaggataaagtggagaataaaagtgtaagggattattatccatgttattaatttaattgccttactcaaactttctcagaaactctgaataaaggcttttgccccattggaaaagtcatctgtttatgaccagactgcaaaatacatgagaaattttccacagcttctctgaggaatccaaaaagagtagaggtctttgatatgatagagcaagaaattactggtattattacactgtaaattgaaggtgacctctatgggaaatgtgccttttcagttgtgaaagagaatggcttgtcgtcttttgaagatgtacacttctttattcctgcatgccaaacacacttgcagaccccaggcgtctggacaggcatcagctactcacatcacagttctctctctgtcctcgccatgggcttcagggtgtgctactctctgcttactcacccggctgctcaccaagtcccctggtaagggattgctaaagggtcagaggaggagggttcccagccctgctccttctaggcaccccagtttccatagtcctcttgcagagttggcctaagacagccttggttacagtatgcagtcctttgagccattcttcctttgggtacagcctaagccttttgcagttggctcacaaggccaggccaatggctcagatcttatgcaagtgtccctggggtttccataactcctagaaacttctagtatccttagtccattgtagttggggacatctattctctgtttccatccccaggactaagatactcccaacggccatatatgctgctaatcatccattggtttccagctatagagaggtttggaatgaaatgcatccacaggtgacacacgtgtgtcacttgtggattgtttattgtgtatagtctgccatgggagataaattgagttaattcctgttttggggttatccctcagaagagagtgaggagccctgggatacagccaaaccaacaatgaagtccccaggcccagccacgatgggcccattaccccctgagcttggttcttatgcgtctccaggcaacaactcccatcaccatgaatgggggtccctgggcagcactaatctcattgttaggtttttgcatagtttgaggatgggctaaagcagctctgtatcagtttcctattggggccataacaaatgaccacaaactgtagcttaaagcaacacacatttattgtcttccagcctagagtcctaaaatcaaggtgtgggtagggccatgtttgttctggaggctcttgaggaagaagctgcttctttgccttttccagcttctacaggccacctgcatttcttggctcattcttcgcttcctccctcttcacagccagcggcacagcatcttcacgtatctcattctgacctctgcttccattgtcatatcttctctgaccttggcactcctgtctcccccttaaaggacctcgtgattacattgagccattcagacgttccaaaataatctcttcatgttaagatccttaactcaatcataaccgcaaagtcccttttgctatgtaaagtaacatatttgcaggtttggggaattaatatttggacatctttgcaggttccatgattctgtctacctcaggccccctctggttttatggttctgtgtgtctcccaagttgcttcttcacagccctcacttcacacatttgtcaaccaccgaggcctgtgcctccttgacctctaacctacatggaagtcagcttgcattatgagtttctcacttcaaacatcagctgagtgtgagcccatctgtaggagctagagtgcttcactttcagaaaagggagtggattctctggaaatccagttccttggcgtatatcacgtgaacattttcatgggtgaggtcacactttgctctcaagatggcaccagcacagtgtcagcccaggtctcaacccggaagtggaattaaacctttcttcccaccccaggtgactttctctgattcaacagatggactgctgaaattccaacaatggaagaaatgttttaccttttggtcaggttttggctcttgctaagcctgagtttgttgctttatcttggttctgcctgtctaggtatttatttctaatcgtggttcaggaagctgaatgtacctgtgttggtccccatggtccccagcacacagctcaatgctcatgacctgggggacagctggaagcttcaattttctgaaatcaagaggaaaataatctatcgtagcacacctggtctttactgtcaacaagagacttacagcctagtagccagcccttcaggacttgtactgagcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggaggcccatcacctcaaccctctggagcttgcctctggggctttcagaaataagcttaattaatctctttcctgtagcagcccctcagacacgtgggggagcaggaaagctctcaggccttccttagattgcttttcctcaaattatacagccccatatcatccaggtttttccttatgagacacagctctaaaaaattcattgtaagttagtcattaatttcatgaatgtcttgatttgtgggaaacagagatgccagtgtctttatagttcattccctttagctctatgtttcagggaaaatatgttgagtggatagcaacaaaacgcatagaggggacagggaaatctttgccccagttcacatgttgctccctggccccctttcttatctgtttcatttacagttcttaactgtttaatgtacttaatgtcttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaaaacaggcattttattgagttaaatcaaattcataatcacaaataaatttgaacatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaaaaaaaaaaaaaaaaaaaaaggtagtgccttcacttcaccagtacgaatttcaggatatgttcataatattgactagtattgaaagagtcaaaatattgacaaatttcaggctgtgttcataatattgacaggtattgaaagagtcaaaaatatcttctgaacaatcaaagaaaggtttctgcattccttgtgaatttaatcatagatgtagtctatacttttctgaaaattagtaatattatatatagtctgcatggcaaccctgtttattaaaatattttaaattaggtttgataacagaaaattgttttacacaggattatggtaatgcataaatttggagggatttttacttaaatcaatgacgtagttacctagggaagacaaagatgtgttcagtccctgaagcatccacttctgcaggcagatagtttacctgttactgacaggagtgtattttcataattctatcataatctataagagtagagtgagggagaaggcagctcccatcactgggtgccgaccgcgtcccaggcacttgctggatgcctcagagacttgatgaagaaaattagtcttttgttttgttttgttttgttttgagatggagtcgtgctctgttgcccaggctggagtgcagtggcgccatcttggctcaccgtaacctctgctcactgcagcctccaccttccagtttcaagagattctcctgcctaagcctcccgagtagctgggattacaggcgcccaccaccatgcctggctaatttttgtatttttcgtagagatggggtttcaccatgttggccaggctgatctcgaactcctgacctcaggtgagcaccttggcctcccaaagtgctgggattacaggcatgagccaccatggctggcccaattagtcttcttcaagatgaatttcactcacaagctcaaatagggagttgaaaaactgcatttgtgatatcacctccatcacttcgggctactcaagagtcagtgtgtaaaaatcgtccctttcatgaccactggctgtaacctaagttcctgtgctcaacaaggcagagaggatgtgtgtttggaaagctttcaacatcagatgtctggctcatcttacgatgtgtgttacagaatatcagctgcatccagtgtccccagacgagaatacaagccaaggcctgtgaaaaggagttctagtgagctcaatggagtttccaccacctctgtagtgaagacgacaggtaagttgaccattctaatatgctaagtgtgcctttagtaaagcacttctagaaacacttatttactgcttgtttctgggtcagtgaatacacacagaccctggatatctttctttggttgtttggtaaattcccttttcccctaaacgtgccccttttttctgttccctggggaagaattctatcacttatataatgtagcatttagaaccttggccatagaaccattatggctacatcatcctttatttttttaactctttgaaaatattttcttaatttatttttaagttgaaattagcatttttgagcaactgctatatgctagatactatcttaagtgctgcatcgttattttttattaaacaagtgatgcaaatgtgtcttttagtaaaataatcaaacagaaaaaaattggtaaaataatcaaacagaaaaaaaaatttaatggtataagtcattctatagtctcttgtgatcacctacaccatcgcagttcgcttcctagatgtagccactgttaaaaaaatttggtataactattatcatatctattgaggtacataaatatacacataaacagcgttttggatttttttctgttttttctttttttcttttttgagacaaagtcttgctctgtcacccaggctgtagtgcaatggcatgaacatggctcggtgcagccttgacctcctgggctcaagcaatcctcctgcctcagccttccatgtagctggaactacaggtgtatgtgaccctgccaggcaaatttttttattttttgtagagacaaggtcttactttgttgcccaggctggcctgcaactcctgggctcaagcaatccttctgcctcggccttctgaagtgctgggattataggcatgagccactgtacccagccttttttctgttttttaaatgcgagattatactaggcatattgtttggcagtttgctttttaaaatgtatcactgtttcttcgagttatttccatatcatgcatatagatctatcccactgttttaacagcttcatagttttctattataccatttccctattggtggacgttaaggttttttccagttatttgctacagtgagtatcctttatcactgtgctggctacattactattaaagcatgaacacctgcttccccacacccatgccagtagacttccatttctgccaagcactcatgagaaaaaaatggtatccagtcttaatttgcattttcatgattattagtgagggtgaactttcttttctatattttaatttgtatttccttatgtctgaattgtctgtttatgtcatttatttgtgttttttgggagtagtttgctttgtcttattgttttataggagctctttccatatgaggatattaataatttttttcctagtttgtcatttatctttaaactttgtttttggagtgccttgtccctttgttgtttttgctgttgtttgctttgtttagttttgctttgagtatacagaagcttttattttgatgtagtcaaatgtgtctgtcttttgcttgtgactttacattttgtgccctgtcatgattacattttgtgccctgttgtgaaaagtcttcctatccctgaagttattcttctacagttttctactactttgaataatcttttcttaatatttagatctttatcataaggatttatttttctaaatgaaaagaaattcccaaactatctttcagagttgtgctaccatttcacatccccaccagcaatatattagtgatctagtttctccacatccctgccagcatttgctgttgtcactgttttttattttagccactttgataggtgtgtaattaatcttactgtgggtttaatttgcatttccttagtgactaatgatgttgaatatcttttcatgtgtttatttgccatctgtgtatcctctttggtgaaatgtttcttcatgtcttttgtccattttctaattggattgtttacatttttactgttgagtcttgagaatgcttgatttattctcaatacaggttctttctatatatgtgatttgcaaatatattctctcgctctgtagcttatcttttaatcctcttaatagggtctttcacagatcaaaatttttaattcttatgaagtccaatgtattcatgtttagttttatagattgtgtgaagtctaggaattctttgcctagccctaaataataaatattttcttttctttttcttttttttgagacagagtctcactctgtagcccaggctggagtagagtggtgcaatctcggctcactgcaacctccgcctcccaggttcaagcaattctcctgcctcagcctcctgagtagctgggactacagacacacaccacaatgcccagctaatttttgtatttttagtagagatggggtttcactgtgttggccaggctggtctcgaactcctgacctcaaatgatctggctgcctcagcctcccaaagtgctgggattacaggtgttgagctaccatacccggcctctcctatgttttttcttaagtccactttgtgttaattttgtataaatgtgagacttaagtcatttattttgcctatggatgtccaattgccctttcaaacacacattgctcatataagctgcacagtgtgaattttcttccaaccttatggctatccttaaaggtttttttttttcatttaaaaacaaaaattatcagagtaatatgtgtatgtagtttaaaaagaaaatggtaatatacgtatgtggttttaaaaaggcaaatgtagttacctctacctctgtgtgaaaacatgggcaggccccatgaattttctcattattaaaactacaaattatcagagtatatgtgtatacatttttttattttttattttatttatttttatttttttgagacaaagtcttgctctgtcacccaggctggagtgcagtggcgccatctcggctcactgcaagctccgcctcctgggttcaggccattctcctgcctcggccccccgagtagctgagactacaggcgcccgataccgtgcctggctaattttttgtatttttaatagggacggggtttcactgcggtgttgatctcctgaccttgtgatccgcccgccttggcctcccaaagtgctgggattacagctgtgagccaccaggccgggccatgtgtatacatttttaaaaaaaacatggtgcaagctttttcgtgagaaatggcagtttccccatcaactcctttcccagtgcttattttctgctctcagaggaaacactttcaactcttttacatatttatttggtacttaacttcatggtgcttgttttttactatttctttttttactctgattcttcagtttggataaatgtattgatttcctgatatggaagataatggcttagcttcctaacccttggtcttccatagacttctccctcccttcacccttccaatttacttataatcactatttttgttaaataaatattcattgtgtaatcatcacttccatcatgtgggactcttaaaatgcactcctccccttttttccctgctcttattttaaattgcctactcacggatgaaaatgtgagcaggctgcatgacttttctgactactcttgggtcacataagttctccagtcacttgaatgtgtaagtgcaggctcgtgcagtagtcaaaatgctaagacccatgtcatggtcaaagctataatcttgatttaaagtttggctttcactcctccccaagctctggcctgttgccgtgggaacattggtgtcagggaagaggttgtatttggctttttctctttccccatctaccccttctgttcttaagtccccagagaatgtattttaagctcgctgaggaatcttttaaaagttcttctctcttgatttggtgtgaaatgaaaagatcacaacacatcctgcctcctccacactctctccaacatttttctaaaaatcctttttaatctccatcttctgacctatttatgccatagatgtaggctgggattaaaagttataaaactggctaccctcatctcttctgtttttgtttgtttccaaatcctgcataagttgtcttctgcacatcggtttaataaaaaagaacaaacaaaaaaaaaacagttctggggcctcatccaaaacttccatttttacatcgcctaacacttatttacaatgtcatgagcacagaaataatattcacagcagtatcacatagtgcactatcattgcatttctattcttgtacaattgttgtcttgatgactgtagctttataagttttgaggtcaggccctgttagtcctctaactttggtcttcattttaaaagttgtttgactattctagttactttgcattttcatgtgagttttagagatcaaattttcaatgtttcaaaaaaatcctgctcagatttttatttggattgggttgaatctataactcaatttaagaggaattgatagcttaacaatattgagtgttccaggcttgaacacaatctattgtatttcccatttatttaggtcttcttgaatttctctcagcagtgtttcactatttttagaatatatacaggtcttttaaattttttcatcaatctctaagtattttatatctttatgcaattgcaaacagcattttaataaaatttccatttctgaatttttgtttctagcattcataatattccattgatttttgtatattgatcttgtatcctgccatgttgctaaatttacatcttaggtctagtagttttttaatagattccatagtttttctacatagatgttcacgtcatctataaatgaagacagttttactcaatatctgcatgcctttgtttttcttgccttttttcacttgctagaacatgctgagtacaaagggttagagtggacatccttgctttgtctctgattttaggggagaagcattcaatacttcataattaaggatgattttagctgtagatttttcatagattttttttttttctttttgagacagggtcttgccctgttgcccaggctggagtgcagtggcgcagtcgcagcttgttgcaacctcaacctgccaggctcaaaagatcctcccacgttagcctcccacatagctgggactataggcacacaccaccaagcctggctaatttttgtatctttcgtagagatgaggattcaccctgttgcctaagctggtcatgaacttctgggctcaagctattcgcctgcttcggccttccaaagtgttgggattacaggcatgagccactaggcctggccttcatagattttaaaaatcagattgagagagttcccttctagtcataaatagtttgaagagagttttaatgagaaacagtctttgaattttgtcagatgcctttttttggtatctgttgagatgatcgtttattttttagttttagtttgttaatatggtgaattacattgttagttaaatcaaccttgcatccctaggataaactctttgtgggaaagtttttttaaattaattttaaattttagaatagttttagacttacagaaaagttgtgacgatagcacagggcattcccatatactcctccactcttctatattaacattttattagtatggcacatttactttatataatgaacatatatttatattagctaaagtccacacttcattcacatttccttagtttttacctgctgttctttttctgttctaggatcctatccagaatagcacgttgcatttagtcctcacatctccttcggcctctcttgctgtggcagcttctaagactttctttgtttttaatgaacttgacagttttggggagtactgtttacatattttgtagaatgtcccccagttgagatttgtctgatgtctttacatggttagactggagttatgagtttctgggaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcaatttctcagacaacttaaagcagaactatcatttgacccagcattcccgttaccgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaactcaggaacagaaaaccaaatactgcatgttctcacttgtaagtgggagctaaacattgagtacacatggacacaaagaagggaataatagccagtggggcctgcttgagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgtttttttttttttttcctgcatgaaggctttaagctataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaattttattgatcttaaagagccagctctctgtctcattgagttttctctgttgtcattgagtcctttcgccttttccgatatatgtgtttagcgctatcaatttccccctaagtaccacttgagcaccatctcatgcattttgatgtgttgagttttccctttcatcctctttaaaattgtttctaattttacttttgataacctctttaactcttggtttcttctgaaatgtgttatatcatttccacatatgtggatatttttcagatctctttctgttttagatacctatttaattccattttttatcaaataagatactttgtatgaatcatacccttttaaattttttgaagcttgcttgatgggccagaatatgatccatcttggtaaatgatctgtgtacacttgaaaagaatgtgtattctattcttattgggtagggtgctttataaatgtcaattaggtcaaattatttaatagagttcttcaagtcttccatattcttgctgattttttggtctatgttttcctattaattttgtggcagagggtattaaaatctctgattatagttatggatttgtctatttctcctggcaattgtatccagaagtatgggaagttggctacattcccttccgtattcctcattcgcattgacccttttagtctgattacttgcattttttaaaacacggaaagtgtgtttttgtttgtttgtttgtttgttttaagatacggggttttgccatgttgctcaggctggtctccaactcctgggctcaacattccttccacctcggcctccaaagtgctaggattataggcgtgagccactgcacccccactgatttatttatttattttttttactatcttaaatatccttctcctctattccctttctttttgcccttgtaaacaactactagaggttgaaactttttgtccttcctcggacaaaaagtcttttcctccttgctctctgtacctctgtttttttattctgccctctgaggacatttcaccttcttactttattctttgatccagttatttatttagcatatctattgaatttcttactccaattgtattagttctctattgatgctgcaatgaaataccacaaactgtgtggtctaaaataacacaatgtatgatctattttatagttctggaggtcagaagtcctcaaatcaaggtgttcacattccacacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcgtcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatctcggctcactgcaacctccgcctcccaggttcaagcgattctcctgcctcagccttccgagtacttgggattacaggtgcctgccaccgtacctggctaatttttgtatttttagtagagacggggtttcaccatgttggccaggctggttgcgaactcctgacctcgtgatctgcccaactcggcctcccgaagtgctgggattataggcgtgagccaccacgcctggcccttaattatgctttttaaaaagtctccacttaattcttatctccttgagtgtttgttgggatctggagtctactttatgaagttgtttctcatacattgatgattcttggctctgtgcacaactttttatttgagagtgcttatgaggttgcctcctgtggttaaggggaaataagggatgttctgttgagtgcagtggactggtttctgtttttctgattgtttctatcatccatggcactgccctgactttctgtttcagatgcccacactcactcagtaccccttcctgaaggcagttgccagggctcctggcactggtacaaacccaggatgagtggactcacctggctgctcttttctcagaaagccagccagctttcaggatccacttacactgagttttgagcgcccttagacttcactgtcacagcattccgctttgggagccattttgaacctcatttcctccatctgctgctttccatcttccaggcattcttgtattcctcataatttctggtctaccagcagtatttagtctcattttccaacattatttgcaaccttaaaaagtcctattttgtaagtgatagggatttggtacatgaaaggaaggctgcagtcctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcaattctcttatattcattccaatttcaaggagataagctacagttttgtgctggagtatttttaatgttcaattttaacagagaggagaggcctccggttaaaagtcatttacagactacagaatgtatcttttggatgtaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagttgggggagaatttcaacttcccatgtgaagcactccccctttcctttctttatttttttggtattctaatttttttccttaggtttttgaggaacaggtggtatttggttacataagtaagctgtttagtggtgatatttgtgagatttcagtgcacccatcagccgagcagtgtacactgaacccaatttgtagccttttatcccttaccccttccaccctttctctcaagtccccaaagtccattgtatcattcttatgtctttgcatcctcatagcttagctcccacttatgggtgagaacacatgatgtttggttttccattcctgagtttcttcacttagaataatagtctccaattccacccaggttgctgcagatgccattagttcatttctttttatggttgagtagtattctaccacatatatataccacagtttttttatccactcattgatgggcatttgggctggtcccatatttttgcaattgcaaattttgctgctataaacatgcgtgtgcaagtatcttttttgtataatgacttctttttcctctgggtagatacccagtagtgggattgctggatcaatggtagttccacttttagttctttaaggaatctccacacagttttccatagtggttgtactagtttacattcttaccagcagtgtagaaatgttcccttttcacccatccacgccaacatctattttttttaatattttgattattgccattcttgcaggggtaagttgatatcgcattgtggttttgatttgcatttcccggatcattagtgatgttgagcatttttttcatgtttgttggccatttgtatatcttcttttgagaattgtctattcatgtcgttagcccacttttagatgggattgtttgttttttttcttgctaagttgtttgagttccttgtagattctggatattagtcctttgtcagatgtatagattgtgaagattttctcccactctgtgggttgtctgtacactctgactgttccttttgctctgcaaaagctctttagtttaattaagtcccagctatttatctttatttttgttccatttgcttttgggttcttggtcatgaagtctttgcctaagccaatgtctagaagagtttttccaatgttatcttctagaatttttatagtttcaggtcttagatttaagtccttgatccacgttgagttgatttttgtataaggtgagagatgaggatccagtttcattctcctacacatagcttgccaattatcccaacaccatttgttgaatagggtgtcctttccccactttatgctttcgtttgctttgtcgaagatcagttggctgtacgtatttggctttatttctgggttctctgttctgttccattggtctatgtgcctatttttataacagtaccatgctgttttggtgactgtggccttatagtatagtttgaaatcaggtaatgtgatgcctccagatttgttctttttggttagttttgctttggctatgtgggctcttttttggtttcatatgaattttaggattgttttttctagttttgtgaagaatgatggtggtattttgatgatgggaattgcactgaatttgtagactgcttttggcagtatggttatcttcacaatattgattctgcccatccaagagcatgggatgtgtttccatttgtttgtgacatctgtgatttctttcagcagtattttgtagttttccttgtagaggtcttttacctttttggttaggtatatttctaagtttttgttttgcagctattataaaaggggttgagttcttgatttgattctcagcttggtctctgttggtatatagcagagctactgatttatgtacattaattttgtatcctgaaactttgctgaattcatttatcagttctaggagctttttggaggagtctttagggttctagggttttctaggtatacaattatatcatcagcaaacagtgacagtttgacttcctctataccgatttggatgccctttatttctttctcttgtctgattgctttggctagaacttccagtactatattgaatagaagtggtgagagtgggcatccttgtcttgttccagttctcagcggaaatgctttcaacttttgtcgattcagtattatgttggctgtgggtttttcatagatggtttttattacattgaggtatgtcccttgtatgccgattttgctgagggttttaatcacgaagggatgctggattctgcaaatgctttttctgtgtctattgagatgatcgtgtaatttttgtttttaattctgtttatgtggtgtatcacatatattgacttgcgtatgttaaaccatccctgcatccctggtataaaacccacttgattgtggtggattatctttttgatatgctattggattcatttagctagtatattgtcaaggatttttgcatctatgttcatcagggatattggtctgtagttttcttttttttctatgtcccttcctggttttggtattaaggtgatactgacttcatagaatgatttagggaggattccctctttctgtatcttgtagaatagtgtcaataggattggtaccgattcttctttgaatgtctgatagaattcagctgtgaatccatgtggtcctggacttttttttttttggtaattttaaaattaccatttcagtcttgctgcttgttattggtctgttcagggtttctctgaagactttttatattgtattatgctaacactagtttgtgtctcaaaaaaaaaaaaaacaaaacataaaaccgaaatgcagtaaaataggatttcctcactcctgccacagtccagggagaatattccaagaagataggtggttctaatgcatagagtctctcaggggtctaggctgatggcagctctgccatcttcatcatatggcttcctagttgttgccactccagccagcaggaaggggagaaagaacaaacatttaggttagatatttcctcttacacccgcaaggtggaaatgacacacacattccagggatgagcgctcaaacagccacacctagtagcaaagcaacttgggaagtacaacctctagctaggcagctgctatccagttgtaatggcatcttagtttgtttgggctgctgtaacaaaataccttagactgggtagcttttacttacagtctggaggctgagatgtctaaaatcaaggtgccagcagaactggtgcctggtagaggccattcctcatagatgacaccttctagctgtgtcctcacatggcagaaggggcaaacaagctcccacaggtcccttttataagggcacaaatcctactcatgacctaattacccccaagtcactaattctcatgacctaatcacctcctaaaggtcccagcccttaatactattgcattggagattaagtttcaacagatgagttttgggggaacacacacattcaggccatagcaaataggaaatacactgcatgtaccagtccataacaatgatggactcctgctgggcagaaatttcaaggaccccctaccctggcagtgaagaaagtgtcttgattagaccctggttctgctctctggattttggatcagggagactcttttgtcttttattctgtgggctcctagatttgctctctgagaaatgtgtcttccaagaccacattgtaagtgggctttggagggctaccttctttgacatctgtacttattgctgctcagggaccttgtgggttccttacagtttagtagacacagatgtcttcaggctaggcttatgcttcttttcacaacttgatttccttttttttttgagatagtcttgccctgttgcccaggctggagtgcagtggtgggatctcggcccactgcaacctccgcttcccaggttcaagcaattcttgtgcctcactctcctaagtagctgagattataggcatgcaccaccacgcctggccaatttttgtatttttagtagagatggggcttcaccatgttggccaggctggtcttgaactcctgaccttgagtgatccacctgcctcagcctcccaaactgctgtcaccacactggccacaacttgatttcttaaaaaacgtaatgagcttctgatctatatacctccaggcagttccatgtgcctgtaaacacattcaaagttctttcttagatatagctcttaagactttcatttctttccttccttgtcttacccatgcttcgctttcttaacttacagaggctaccttgagaccacctgaaacagcagatttgagtaggaaggtgacacctttcgttgcgtctttgccacacagctgagttcctttagtttagggaggtctctgagaatgatttggaagagcaatctgcttatcttgttttctttggggtacagaaacagtttgcttttccaatgcattaggaaccaacctctgctctttcttttatctttgcttgtagactgggcaacttttgtctttcttatagtaacttgctacacacaccaaggtttagctaacatccaaccttctggctttattcaccttctttctttagagctactggtatatggtctgctttaagagttattataggcaaaaagtttttcaaatgttttgccataatctaacaggtcactgggtttcagcccggtgcggtggcttacgcctgtaatcccagcactttgggaggccgaggcgggtggatcacctgagttcaggagtttgagaccagcctgaccaacatggagaaaccccatctctactaaaaatacaaaattagctgggcatggtggcgcatgcctgtaatcctagctacttgggaggctgaggcaggagaatcccttgaaacccgggaggcagaggttgcggtgaggttgtggtgagccgagatcgcaccattgcactccaggctgggcaacaagagtgaaactctgtctaaaaagaaaaaaaaaaagaagctaggtataagcaaattaactaaaaattttgacagtgagttcaacctcagcctccctccttcaatgccagtatattatatttgaggaaatgagaacccaggaccccagggctcagtccttgccccactgtctctatctttccagcttgcacccgagtagttcttagagacaggacctcaggtcaagctcccaagacaccattctctcatttgccaccaaagagaactcaactttcctttgatttgagctcacagactggcagtgtagagagtgttaagccttataaaaatgaaaaggtatttgaattaaagtatcccttaaggtcatagggacctagcctttgagggccaacagtatgccaggagttattatttggtgctttgtagacatagacataactcatttcatcctcataaccgtactccaaggaagtgataataaaaaaaagtaacacataataagataatgacaatagcaactacacttattggctacttactatgggttagatattgtataaatactttgtatacatctctagtactatttttagtccccattttacagatgagtaagtagaggctctgagaggttaagtgagatcttctcaagatcacagagccaggaagtagcagagctgggtactttaccttatagatatttcatgttatatcattaagaaggaatactaggggaatgttatgaaatggccaagagcattgggaatgatttatttccaagattcatgattacagggaatctgtggtcagcaggtggttgcacagggagcccactaaatgcatctgacttggaagggaaaaacagaggacagtgaggtctttggcttcctcattgaggccacgcatgtcagtgctttgtcccctctttcttggccagtagctgggtccctagacagattaagttcctagaagggcgatgtacagagatcacagacgtgcagaagctggcttttaagaaggctcagtgtcccatattctccactgcagcaaactctactgtgtgccactgtgtgtcttttgcctgtgcctgtcccaggctgcttcttctaagtttccctcggtagtagcttcaagttcccgtctcacacacccagcattgggcttccttgatttgtgggtggaatttgccagtgtaaagggggtcctgtactgtttgtttctgaggcacagtttcaaaagaaaatgacatttatagcctgcattaatgggaaattactttccattaggattctgaatgatttgcacataatgtttataaagtgaaggaaaaatgtcaagcatttcactaacaaatgaaagcaaagctcatgagactctgccagaaatgaattccaagaacattttcttcatcatttcttctttctaaagaaaaaaagagagagatgaaagaacataagtcaattaagcagaatgcatcgtgggactgagatggaatctttgataatatcattgctaggtagttaagagaatgaataaagtgagccaaaatggagaaaggggagaatcacatcttgaaatgacagattgcagacaaaatccaactctaggtcctggctgggagaaacgagtgcctgtccaagcccgcgagtgtggggtcatgctgtttcatcagtgtaagctgcccctctgtccccaaagagaaaaggaggccaggaaacatccttgagttgaaacatgtgcctgtgtagctcccagaaaaccactgatgttgaagaaaatagtgtaggaatttgtgacccatgctcaagtatcttccccacttgtggggaatttgtatcaggtcccaggttgtcacctcctgaattatatatttaaagactagaggacaaagtgtattttatcaactcattttttatgaagtttttttttttcttgctgaaactcttaaaaggggtaccactttgtgtaatcacaactaagggttaatatgccccaaactgggacctgctttaaacatataggaggctgaaattagttaacaaatatgtattccaaatgtgtgctacaggcacatcagagtgagttgaaataaatctcccaaatggcttgtattaagaccttctaattctctaggtataaaagagacttttataaatttcttcacacttctaaggcagcttggaaataatttctagagcctaaatccttcccctcattggcacaaaatgtctaggattacattagaaaataaacatttattcaaaagtgaaatgtgaagtttgaaaattaaagatgaacactttgcaaatagaaatatatgcaatttttttaacctacatttccgaagaggaaattaaaatttcacagaacagtgacaatggtgattgttcggtcagcaggttgtttcttacatttctcttctttccttcctcctcttttcttctattccccttctccactaatagccttccccccagatccatttctatatattataagtagtgcttcagagtcagagttattgacaagagagaaataaataaggaaacaagagtcccatgttatagttcagattctggaacttcttagttgtatgagttggggtgagtttcttagcacctctagaccgatttgaacttgttcctagaggaagtgattggacttaatacattccaaggtactttctagctctaaattctgtggctgtagtagttgtcttttgtgagtacttagcattcttaataatttgaaatgtggacaggttgaacatttaaatattttctatattttaaaaaatgttttaaaaattaaagtgtgaaatatgattattattgttgatcagtagccattggtgcggtgaacaggaagagtctctctcttattttccaatttgaaggaagatttagagagggaagttttcctcactgcagggaatggttttctgtaattattctgaacagtctgtaaaaagagttttgaaaagccgtaagacataaattctaacttagttgtgggaattttgactttgctgaaatgatctcaagtgctgcatattttcaaatcttaacatatactctataatgatacatttgatccataagctaaaatgtaaaataccatcatctaaatattaatttatgtacttgttttaaaaaatacggtagaagtcagttgtttcctgggattacaaaccaggcaacagtgatgttgcaccatccagaggactctgagtccatatgaatgacagcccctagagttgtccagtggatgtggctgcaagtgcaaacttgaatgccagattttaggaatgagagacataggaaaagtgtaagaaaatagtgcaaggctggtgataaatggctgactctaagcttccaagtcaggatcatgacagagggaggtgtgtcttcaacaactagaaaacacttgttctttctgaagggggtggccgatagtctacggcaagcgccccttgcctgagaatgtgagcccatcatagctagcctttctgatttttcaagagaagccagaaaccctatgtttatgtgacatctcctgacttttagatgttggcaactaatccacattgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcacaatagacaagtcattgttttgtaaggtgggggagggcaaaactttattagttaaacccatctaatataacccgagtaaattgaggaagattggcattaaggttaacataaatcacacatgcttatttttacagatttcaatgattaagcttgagttccattgacaagtaatttcaataaatcacatctcctgtggataaatacagggctgttatttctagaaagacagcagttcattgacttttactagattttacttagtagtgcacaacttaaccctcatagaccaacacttcaaatttccagataaggaaatcaggacccaaagatgacctaatccatagcaaagatgcagggatctgaagcttctgtccagtgcgctcttacccatggacaaaaacaatatgttagagatgttgaactagatagtgtctgtggtatctatcagcattagacaccagtgttgtatctgggtcagatagagagaaagtatgtgcttcaaatgaattctgctataagaatttgagattataaatgggaaaaaagaaacttttgaagggagtttaaaccagatatgcttgtttgaactcagaggagatggtatctcacagattgagcacggtgcctggctccatgctcctggctccatgctttcaaacactcggtgagagtttgaaaatgaattggaaccagaaataaacctgaaagttccaaattgggtttctacccgccccccactccccccgcccgcccatggtaggagatgaactgtctagtctgatggtgcaggtacagtcaaacctcagggtaacctgggttctgggatcgaagcttctaggagacttggggtcccattcctgactggggcatggactcccctcatcaatggttaccttcctctctgttcatcagctgctctacaagtggtgtaagtaataagggaacatgtttggatttcctgacttcaggccaggaagtgagcggaatataagcccacccagcccaaaggggtgttaacctgccttgctggaaagtgggctttggagtcagagggaagcccagatcctggctcagttcatacctttgggtctcaatttcgtcatctgacgagtgcggattctcattgctacctcacaggattattctaaggattaaattagatcttgtgaattaggggtgctgggaaagggactcggtacagagtaggagcccacaatgcagcgctgttaatgttacataatcggttatctgatttcccagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggtcagtagcttctgggagactccataccttgtaccccaacagggacttatgttgacagcgttgtatgaattacttctctctccatcccctttgccccttgaaataactatgggggtggggtcatagtttgcctttcagtggggatgctctgaccgaatgcttccaggtcatgaagttcccaaagtcaaggccagcaaaggagcaagcacagtgggctccttcggtggtctgaaaagaacccaagttccacaaaagagctgtgagttttagtgcaacagagagaaggatgccccttgcgccactgaccactctttccaccttcacctcccttaaagtcagggttagagatggagccctggagaacaggcttccagatcctggcatgtgggagagagagagagagaaaatgagaaggccaggctgcagacacgccagtcccttctgatgccatctctactctggtgtctaatccaccacctggagtgggcactgtttttaactgaagcctgagctgctcactttgaagctggaactcaggctgaagaaggcaggacagagactaagtgcctggaagttatccctcaagtgcgacaggcaaggctaggtgggacctggacagaccttcctggggatctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaaggctgggcgtggtagctcatgcctgtaattccatcactttgagaggccaaagcaggaggatcacttaagccctgaagtttgagaccagcctgggcaacatagtgagaccccacctctatagaaaataccaaaattatccgggcatgatggtgcctgtagtcccaggtactcaggaggctaaggtggaaggattgcttgagcccaggaggtcaaggctgcaggccaatagcagggcactgtactgcagctcgaggaacagagcaagacagtctcaaaaaagaaaaaaggaaaaggaaaagagaaaagaaagaaaaagaaaaagagtggggataagaccacaaactaacaattttcagggggtatattgcatagggatcaagaacgtggactctctacctggcccgaggtcaagtctcagtgttgtggcttaattgtgttaaatttgtgtcctcaatttctccatccctcacattgggggaaatagtggtacctactcataggatttctctgggaattaaatccataaatccactaatatctctgagacacttaaaatattgtcctggcacatggtaaacactaacacctgagagttattatttcgtccctgtagctgagtagggctgaggaattgtaggattggaccgcctctaccttaataaaatgtgctcagcatttctgcatatgcaagtaaccctttgcagcagcagggacttcagccaaaaaatatatatatatatatataatatgtatgtgtgtgtgtataaatgtatgtgtgtgtgtctatatatatatatagagacaaaataagtggagttgggggaggggcaccgcaaataatgttcctgctgttaaaataagagggactgaaccatattaatgccaagggggaagttcagtttatttcaggggggacgtggttttcctacctcctactgtgttactgatacagtacttactgaccagccgtcttaaactcttgtggtagggtctctctctctctctctctctttctctttttcctaatggtgtggaacagagcttgaataataaatatttaacagggacactcccttttctctgttaaaataatctttgtttcaatactttaacaaggaagactgtgttttcccacctctgctctcacgtttcgttgaagccaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctacacaactatgcccagcgattccaggtgccagctactgaatgtgagagagcaaggaggtggaggtggatgaggaactgccagctgcaggaccacaggggcaaggggaaggggttgtcaacagggatgggacgctgggtaggatcagtcttttcttacgagacgttttcagctgaggtgctggcttctgatggtgggaaaccaagcattcaggtcccttggagaggcttatatctaacagttggaaagcctccattgaggaaatccagcccattctgcctggactttggggctccatccatggtgacttttgtgtcaagggaaaattcacacactgtccctcaggcgggcagcaacttaatttctctttagctgaactgaacttgcttgcaagcctctatgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgaggggggtttacagaacatcatggtggcaggtagggaggctcacttccacagctgaggtgactcgtcacaggaggcctggggcctgggccaggatctgtgctgacatctgtggcttaggcctccctctctgggttgctgaatctctgtatttggagccgtgtgtcactgcccccaggcagcctctggcctcagtggcccctcagcacttcctgctggggacttgagggaatttgttcacagttcacagggagcgaccagccttcaggccccatctgtacttagtgacaccacatggtttccactgggctccagcccccgtgttagtccagagaactttgacagctgccttctcccgggatttctgtggaaagtggagtctaagacccccttccccagggtggcatccaaggagcatttcaattttcttgctcaccctcttctcactgcaggccccttccctgcttccctgcctccagaaagagcttgtatctcttctctggatggcaggaaacagctcctccctctccatggcttgtaatcaaaatgctaggctctgagttcttcaagctctagttcttggaacccagaagtttctctctctctctcgctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgagggccccaggcaacagaaatgacccagaatgaaaaatgcattgatacttcagaatatcgtccggctgcatgtataattcagggcagccagtctgagctctggttggggtggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttctgtgtgtgtgtgcagcaagaacccaggtttacacatggaggtggtggcctggtttacacatggaggtggtgcatacacttggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcagcctatgaaatgtcttggcaacccttagtggtgtcatagatcatgtacgaggtgacatggagcaaggtagctgatggcctagggtctggagccctcctgtttctggctcagccagtagccctggggccaggccattatgacctctcagaggcattgatggcttctcttggaaaaggagaggactcatggaggactgccaaattccattctagcattaacattctgtgttcaaggaaatgcttcccgagactaccatgtggtttggcacctgaccccttctctgttaaaaactagtctagtagtgggagaaatgctaaaagaataataattatttttataatccacattaaaacagttatacattaataaagtagactttgactcacagctcaggttgcccttggttttcagtgctcagcccccacctgcccacccatatacacactccatgacccaaggaaaatgaaaagttctgtattgtaagccctctattccccatgctttgtttgaaatcattgaatgttgttctgttcaaattcaaaatagtgaactaatccccaatatttacagccttccaccccctagctttcatcattatgacaagaggaatacacagacttaggcaggggtggggtctgtcacggaaggagctgtctagaggctagaaacatcatgtagatcatagaggttatattgcaggtgggttcagagtttcaaagtcacgacccagtacaggagctgcctccctgaagaggaagaagagctcccctaccattacccccttctctttcctcgccagctgagtctctttaacctttaacgcttccttaggggaaggagaggggaggatcatttcactggtggttgtcaacctaccctggacataggaaggacctgagaaacaaaaaatactgatgccgggttcaccctgggcagtgggctgtttagtgtgccaccaagttgagaaccactgccataggaaggcaacaggaagccaccttggtacaacctggggagctccgctgatgaaggctccttagagtgccctgttccttagagatataggcgctactccatgaatttcaagctgtctaaacaactataatataatccttctcacaacaggaatctccattgccccaactcttgtcttcctcctcccataatgctgtcacctctctacccctccccaggacaaaggggcatctcatttggccagccacagaaataccccaacgtacctattctctttacttggacctagaagacttagtggagaaagaacataatctctagcagaacttgttcaattctcacttgaagtctagagggaggaaaaagtcttataacagaaaaaggaaataaaaatggaaatcatcaaataggatggcaaaagtcacttattaagaaaaaaaaaaactcctaagattaatcttattaatactcaaagaaaaaaagtatgaactagtcaaaattgaagtgagatttttgtgagagaaatgtgtcatattaatactgaaatatacctagttaaatgaattcatgagaatagcaaggaaatattgaaatagaagggtaatgactatgaactagttttactagttattaacattttatttatttatttatttttgagatggagtctcactctgtcacccaggctggagtgtagtggtgtgatctcagctcactgcaacctccgcctcccaggttcaagtgatcctcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattacaggtgtgagccaccacacccggcctgttaacatttattataaagccacagtatttaaaatgatatggtactgttaccaaaatgagtcagtgggacaaaatagaaaaaatccaaaaatagatctaagtcccatgatgattaaatatatgataaagataaaggcaatacttgaaatcactggagaaaatatggattatttaagtatgttgttatgactgcataagcattattaaatataatagatatttacctcattttgccaaaatccaaatagattataaaagttctgatgtgaaaaaaattaaataaaaatactagaataaaatttagttgagtctttatataggactgtggagaataaaccatgaatagaaagtttgattagtttgactgcttatactcttcaatttgtgcattcatgccaaaacaaaatagaaacccctttccctgccccactgccagcacaaacttcaaaaacaaaatgagaaaaaaaaagaacagatgataagttgggaataatgtttgtaccagaaatgacagataaagggtaaatatgtgtagtataaagggacttctaaacatcttaagaaaaatagtgatattaggttggtgcaaaagtaattgcaggttttgccactaaaagtaatggtaaaaattgtgattgctttttttttttttttttttgagatggagtcttgctctgtcccccaggctggagtgcggtggcgcgatcttggctcactgcaacctccgccttccgggttcacgccattctcctgcctcagcctctccaagtagctgggactacaggtgcccgccaccacgcccggctaatttttttgtatttttagtagagacagggtttcactgtgttctcgatctcctgaactcgtgatccgcccgcctcagcctcccaaagtgctgggattacaagcgtgagccactgcgcctggccactgtgattgcttttgcaccaacctaatagaaaaataaattgacactaaatgtcagatattttagaaagaattcatgttctatgaccatgaaatccttttcttggaatttatcctcagaaattaatagtgcacatttgtagatatttatgtataagctctttttcccaaagaattgtctataaaagccaagggggaataaaagagacaacagaaagaaatgaagaaaaaggaagagaaatcgagaaaaacagggagggagaaggaagaaaagaatgaaggaaggaaggaaaagaagagatgaaaagaagagaaggaaggaaaagaaagaagaaccgtaaatgtccaacaataggagattagttgaagaaatgttacattgtgagagctgacagctagtcagtaactaaaattgaaagatattcaccctagcttgtacaagaagaatcttttatgaaaacaactatatgtaaatatatgcacaaatataatcatgaagacatctggaatctgaaagctagcccagttatctctggggtaatggtttacagctctgacttttctttctccactttgcatacatgtattttttgtttacaattagcatgattttgttttgaaaaaaatgtttttgatgttattctgggactagatgtcagtaaatattcttgtctgtaaattctggtctgtaaatattcttgcctttcttgtcctggtttctctcctcccggcccttgtcctgcccattaactaggaagatcttgctgaccaccaaggtcctccctactaccctctccccagagctcctgaaccatgagtgatacacacttcatatttgttctttaaaagatttttggccatgcacagtggatcacgcctgtaatccccacactttgggaggttgaggtgagcagatcacttaaggccaggagttcgagaccagactggccaatatggtgaaaccccacctgtactaaaaatacaaaattagctgggcgtggtggcgcatgcctgtagtcccagctgcttgggaggctgaggcacgaaaatttcttgaacctgggaggcagaggttacagtaagccaggatcgcaccattgcactccagcctgggcaacagagcaagactctgtctcaaaaatagataaataaataaataaaagtttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaa

SEQ ID NO: 1496 - DNA, 171403 bp, Homo sapiens; identical to SEQ ID NO: 1495

SEQ ID NO: 1497 - DNA, 146573 bp, Homo sapiens
gttgcccgggtgacggctgcggaggtggcggccgggctgggatagcgcgagtgtccgcggccgagcagcaggtaagcgcgtccccggatgcagccgggccaccctccgcccgccgtcctggtgctgggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccgcaagtagtccctgatctttgctgcagtgggccatacttggagggggtccctcaagccatccagctggtggtggcggcgcgagcgggttatccgggatttagatccccctgataatctccatctgctagccgcgttcctgaggcacccagttgaagtccagacttcacctaatcttaggaaaaacaggatgcgtgctatgcagattcggcttccatacaaatcccataatcccacccgtttgtgggccctaaatctttcttatataggaattcaaaagctgccgctgcaatccccaaatgtaactggaaaagtttttcttagtttccgcataaaggagagcactggttctcaaacttgagagtgtgtaaaagtcactcagggagcttgtttaaaaggcagatttctgggcatggtgcctgccacggtgttcagtaagaccagggtggaggcaggaattttcatttgcacaagcgtgccagctgattctgatttaggtggtccagactttgggaaatactgtgtagtggttcttttcagccgcttagtcacttactgtggctgttgggagtgtgtcagacttcctgggcctcaaattgcctcatctggaatgggaaaatataaactatattcacctgtcaggtttactatgaaggttaaatgtaaaacattttgcacattgcctggcataccatataccttcaataaatgatacctattatgatataaaagtttagagaaaattctgtaatttctttttcttttcctttttttgagacggagtctttccctgtcgctcaggctggagtggagtggcatgatctcggctcactgcaacctccacctcctgggttcaagcgattctcttgcctcagcctccctggtagctgggattacaggtgcagacgccaccacgcccggctaatttttgtatttttagtagagatggggttccaccatgttgatcaggctggtctcgaactcctgacctcaggtgatccgcctgcctcagcctcccaaagtgttgggattacaggtgtgagccactgtgcctggccaattctgtaatttctaagaatgttgagtaataggatacccagcagcactcacattcaatgacagttgatcacagcagatactatttaaacggcttagggaggtctactctaaggaggtgatgtttattaggcacagtggttaaccaggtgaagagagggaagagtgttctaggcggagagagtaatatgcgcaaaggccttgaggttggcctcaaggtttcaaattctcagaaactcacttttcccgttccagggcctttaaaatgacatcccctcagctccggcttcatttattcattatatgccttgagtacctttcttgcttactagacactctgttaggttctggggatatgaagttgaaatacagctccctgtctttgtgaacagggttataagaagtgccaggtgcagtggctcatgcctgtaatccctgcactttgggtgggtgaatcgcttgaggtcaggagttcaagaccagcctggccaacctggtgaaaccctgtctctactaaaaatacaaaaattagctgggcgttggtggcggacgcctgtaatcccatatacttgggaggctgaggcaggagaatcacttgaacctgggaggcagaggttgcagtgagccagattgcacctttgcactccagcctgggcggcaaaagtgaaactccatctcaaaacaacaaaattagctgggcgtcatggcgcatgcctataaccccagctacttgggaggctgaggtgggagaatcacttgaacccaggaggtggaggttgcagtgagccgagatcccgccactgcactccagcctgggcaacagagctaaactccatctcagaaaaagaaaaaaaaaaaaaagccttggtagggaaagaagggaggggtttttcatggaagacttcttgaaaagagattaaatctggcttggcttagaatcatgagtcatgtttgcctgggggggcagagcatacatcaaccacaggcttaggatcctggaagagcttgttgcatgggggaatggccaggagttcgctgttggcagggtccagtgtgggattggtggaagggagcaaggagagggatcaggtagggggaggtggatggattggaggcatggtccagaaaaaggctggagaggtgggtgtccccaggagcagctgcctttcttctctccccttttgcatctggcagggctggtgtggtgcatggggaggtgtcctccctgctcctcattactgcttccagatcactacccactccttcacaaaccccagctcctttgaagcacatggcagatgccataccccttgccagccctccctgaggtagccacttcccagggcaagtctctccagttcccttggagcctccagcacccggctggctgcctatcccttcatctcttttacttcacttttgggggtttccacatcctggcccctccagtttcttcatcctccttacttgcaggcgtctctttcctccatcctcctcatctgcccactcccgtggtcgggagctttttagtactagtcaccttcaaagtcttgccttcaggcatctgtcccactctctgcccactcctttccatctttcacactcactggaatgtgcctccttcagcaggtctcagaccccactgcttcctcactgctctgcagccgccttatgtgtgttcccctcccccattcttaacctgattagttccagtgtcccatcgtggttgtactgttttccctttcctctctcttctagaagaacctctcacattggttaacctaactcagatagctgaaagtgcctggagaagagctgcaaaactgtgcagactgattccattttagattcaagtgcagagatcttaaatggactataataccagcaaccctgccatgttgctgtagtcgctttggttcccaccctcccttccgttcccactctcccttctcttcgaactgtcaccatgcttcttacttgcagccgatgaccttttttctttctttcttttttttttttttttgacagagtctcactctgttgcccaggatggagtgcaatggcacgatctcggctcattgcaacctccacttcctgggttcaagcgattctcctgcctcagcttccagagtagctgggattacaggtgcctgccaccacacccggctaatttttgtatttttagtagagatggggttttaccatgctggtcaggctggtcttgaactcccagcatcaggcgatctgcctgccttggcctcccaaagtgctgggattacaggcgtgagccaccgtgcccagctgatcttgtttcttgtttcactttttttttttttttttttttgagacagggtcttactttgtcacctaggctggagtgccatggcgtgatcccggctcactacagccttgaccttcctggttcaagtgatcctcctgtctcatcctccccagtagctgggattacaggcacacaccaccacacccagctaatttttgtatttctgtagagatgaggtttcaccacgttgcccaggctggtctcgaactcatgagctcaagtgatctgcctgccttggtgtcccaaagtgccaagattacaggtgtgagccactgcacccagcctgtttcacttctaatcactaaatctgtgtctttgctcagcacccatattctctgctatccctctgaatgccgttcctgcttctcccttaaactccaggctcatatatctgtaagaattaaagaaagaggagagaaacacgaagggtgacttgacagtcaacaggtttgtttcctgggtaacggccaaacttcaccctcttacaatgggcctcagtataacagtgggccttaataaggacattctgttcccttcaggtgcactaagggaagctaaaagcagacttggggggtatgcctgcagctgcagaaagttgtataggaacagacacacaactctccctcccagataagcacaacagagagacacagaaacagttcaagcctttgataaactctcccaccctgaatccttaaaaactcttagtctgtaggagagtgtggctctgacctaactcggtcggaagtccctcccaggtttgaaataaacctgttgactgtcgagccacccttcgtgtttctctcctctctcctctttctttggttcttacaatacccactgaccatttcggaacctccactggaatgtctaacaggcagctcagacttatagccaaaacagagctcttggtttgacctcaaaacagtccttccccaggttttcgttgactcagcaaatcacatactcttcggccagctgctcagatcccagggttcttccttcccttcttcccctcatgtcccacaactaactggtctgcagattgtgcctcttctgccttttccatctggactcacagcgctcatggcccctcttgcttatccaaatgatgctcatggctggcgtggcctgagcagtactcatctccctcttcccactcccctccagtcttctctgtagagcaggcaacatgcatattaaaaaatggacatcagcagccgggcgtggtggctcacccctgtaatcccagcactttgggaggcagaggagggaggattgagcccaggagttcaagaccagcctgagcaatggtgaaatcctgtctctgaaaaaaccaaggctgggcgtggtggctcatgcctgtaatcccagcactttgggaggccgaggcaggtggatcacctgaggtcaggagttcgagaccagcctggccaacgtggtaaaaccccgtctctactaaaaatacaaaaattagctaggcatggtggcgggtgcctgtaatcccagctactcgggaggctgaagcaggagaattgctggaaccccggaggtggaggttgcagtgagccaagattgtgccattctactccagcccaagcaacaacagcgagactctgtctcaaaaacaaacaaacaaaaaaaaacctcaccaaaaaccaaacaaatgaaaaaaccagaaaacaaaagacttggggcatagtggcacactctgtaggcccagctactcaggaggctgaggtgggaggactgcttgagtccaggagtttgaggctgcagtgagctatgatcatgtcactgcactctagcctgggcaacagagggaaactctgtctcaggaaaaaaaaaaaaaaaaaaaaaggacatcagtggtgtcagtcccctcctccatactctctctgagcctcctgttactgtcagcctaatgtccaagccacttaccagctctgtaaggcccacctgacctggccccggccccccattgcctgctgctgtctgcctcacccctagctacatcccaataccccaagactgcagagctcttcagcctgaggcctgtgcactaacaaagccatcttccccagatccaggtgctcaatctttgctgaaatgtcacattcccagtgaggccatcaaccactctatctaaaataaccccatacccgtctccttcaggttctgtccctttccttgcgctgttttcttcatgtctggaatcaatttccactccgtccatgtttttgagcctgtactgtgtgccaggcactggtctaggcacaggggaacacctgtcaggtgctgttgagaaaaatcaagcagtacaaagggctgagaagtgatgggccgacctcttagaaagggtggtcagggcaagactctctgaggaggtgacagttaggcagagacctgaatgagacgtatctgaaggaagggcagtgagccagagttcacgagggcaggcgtgtgctttgggtgttcagtgggtgtccacaggaaccacacagtggccagtgtggctcaggtttacagaacaaatgggagtgtgtcagaggccaagttgtctagggctttgggagttgagcctaaggagcctggccttcatctggagggcgctggaaccacaggagggtcccaagcaggaggggaatgctcacttgttaaaagtgtagaaattggattgaagtggagagaaaggaggtggggaggcagtggcagaaaaatgtaaggttacagactcagaagagatctgactgagtgtggtggctcacgcctataatcccagcattttgggaggccaaggcgggaggattgcattacccaggagtttggcagcttagtaagaccctgtctccctgtctctacttaaaaaaaaaaaaaaaaaaattacctgggtatggtggcatgcacctatagttctagccactggggaggctgaggagggaggatcccttgaacccaggagttttagcttgcagtgagctatgattgcaccattgcactccatcctgggcaacggagtgagatcccatctcaaaaaaaaaattcgatgagttctgacacattctgaattttatagatgaagaaaggctctgcacttcagtgagttgtctcagatcaggtgccagtgaatggcatggttaacattagagcccagaccttttcattcctctggggttacgggcaactgctttgggctgagcctggggtgtgggccatggggaatgactgctttgggtacaccttgagggagggctagtagaaagagtaggaagagtttcttttgactttagccattgtatttcctagtgccgctgaacaaatgaccataaactgagtggtgtcaagcaacaaagatttaatatcttctagttctggaggtcagaagtctgaaatggctttcactgagctgaagtcaaggtgtctgcagtgctggatcatttctggatgcagtgggaggatctattccttgccttatgcagtttttagaggctccttaccctccttgtcttatgccactttatcccctttaaagcctgcagtggctgttgagtctttctcacatctcatcatgctggcactgaccctcttgcctccgtctgcccccctccctctgctgtgactgccttgggcccacctgggtaatccaggatcatcccccaatttaaaggtcagctgatgagcaaccttaattccatctgcaccttaattcccccttgccgtgtaacctcacgtattcacaggttctggggattggcgcatggatgtctttgggggccattattctgctcaccacaaccacctttttgtagtttcataggtggttgaaatgaaagctgttgtcttgtatttttgccttctagagatttttgctgtgagaattaattaccagtaacagttcaatatgggggacattctggctcatgaatctgaattacttggactagtgaaagaggtaggtatattatacaaagcagaggtcacagagaaacagatcttgaaaacttgtgttttaaaatgcaacaaactatttagtgccttgtaatgtttcttctattgttatgttggagctatttttctattatataatattccatgtatttacattttggttttataactaaacaaatcttaaagccacttaaaaagtcccttgaaagaaaattataaaagcaatacacgtccacggtaaaagattcaagcactacagaagtataaaaaggaaatttccctcccagacttttttctatgtatagtaaaaatatattcacatgcctgtagtttgttttacagaatgggatgatacattgttctgtagcttgctttttatctgccaacaataatatagcatgaacatctgcctatgatcggccctagacatttgaatgccatagagtatttcattgagtggctgcatcataatttttttaactcattgtctggtaatggcctaggtttcctacgctaaaagctttgacaagtagggcccaggccttaaactttctggtgctaaagaaatggttcgcgcttgctgctgcttaactgtgtgagtaaccacctgcaggttgcgagagccacgggcctggagcagggatgaggcacccaccgtgcaactgcagatttggaatttggtggtgtgatggcgaatatattcttttttaaaaaatttacatttaaaaatctttttagagacaaggtcttgttctgccgcctaggctggagtgcagtggcatcatcatggttcactgtagccttgaactcctgggctcaagcaatctgcctgcctcagcctcctgggtagctgagactacagacgtgcaccaccatgctcagctaggttttattctaatttttgtagagataggatctcactctgttgtccaagctggtcttgaactcttggcttcaagcaatcctcctgcctcagcctcccaaagttgtgggattgcaggcatgagccactgcaccctacctatataacacattttcttttaaaaatttatttatttgagatggggtctcgctttgttgcccaggctggtctcaaagtcctaggctcaagcgatcctcctacctcagcctcccaaagtgttgggattacaggcatgagccatgccacctggcctataccattttttcttttttttttctttttttttgagatggagtctcactctgtcgcccaggcaggagtacagtggtgctttctctgctcactgcaacctccacctcctgggctcaagcgattctcctgcctcagcctcccgagtagctgggactacaggcacgcgccactgcgcctggctaatttttgtattttcagtagagacggggtttcaccttgctggccaggctggtctcgaattcctgacctcgtgatccacccgccttggcctcccaaagtgctgggattacaggcttgagtcacggctcctggccggtagttctatttttatttttttgaggaacctccatacagttttctataatggccgtaccaatttacagtctcaccaagagtgcacaagtgtttccttttctccacatccttgccaagactttttatctttcgtcttttttgtaatagccattctgacaggtgtgaggtaattaggtctctgtggttttgatttgcatttctctgattgttagtgatgttaagcaccttttcatgtatctgttggtctttttaatgtcttctttggataaatatctattcagatcctttggctgttttttaattggattatttgtttgttttgctgttgaattgaattatttattttttatagtatttagattttgctgaatttgaagacaccttgaaaacattttcaaaagaatgcaaaataaaaggaaaaccattgtgtaaaacagtaggcggatctttcagagactccaaatcattgacaattcaggtaacattttgcttatttttcatccctgtagataattcaggatgctcccaacttgtggaaaatgctgctgttggatagtgctagaatagtttttgagcacttgctcagagttactttagatggcacaagtgtttatagatgaactaataatgtcattttaaatctctgtaccctccccaggaaatgtgtggccatataagatctttcacaaacatttcttgggaagaaggaaaagaagaaaccatgcagtgtttaggaactgagacaattgtagccttcctcctgaggagtttcaggttattaattctaggcactggggatccagcagtgaacaaacaaaatccagccccttgccagcacagcatttgcattctagcttggggaggttggagggaacagggagcaagagtgagactgacaaggcgggtctgtgaaaggaagtctgaatagctctgtgaataccagtgggctgcaggggcacagaggttatacagacctcaactctcagggttagaagggaccttaaaaatccttgactaggcatggtggctgaatcctgtaatcccagcactttgggaggctgaggcaggaggaccgcataaacccaggagttcaagaccagcctgtgcaacacagtaggacctcgtttctttttctttttttttgagatggagtctctcgctctgtcgcccaggctggagtgcggtggtacgatctcggctcatcaccacctctgcctccaggattcaagcgattctcctgcctcaccctccctagtagctaggattacaggcacgtgctactgcgtctggctaatttttgtatttttagtagagacggggtttcactacattggccaggctagtcttgaactcctgacctcaagtgatccgcccgccttggcctcccaaaagtgctgaggttacagatgtgagccaccatgcccagccagaacctcgtttctataaaaaataaaaaattggccgagcatggtggcatgcacctgtagtcccagctacttaggtggctgaggtaggaggatcacttgagcctgggaaatcaaggctgcattgagccatgatcatactgctgcactccagctgtagtgacagagtgagaccctgtctccaaaaaaattaaaaagtcattattttaaccattatttgatgtctaaatctcatttgtaatatgccaggtaagtaatcagttcacctagaatatttccattgactagagactgtaccatttcctgagacagcatgtttcacatttggatgattttattatttatttatgtatttgagacggagttgcgctctgttgcccaggctggagtgcagtggcaggatcttggcttactgcaacccccgcctcctgggttcaagcgattctcctgcctcagcctcccaagtagctgggattacaggcacacaccatcatgcccagctggttttagtatttttattggagatagggtttcaccaggttggccaggctggtctcaaactcctgacctttggtgatccacccgcctcagccttccaaagtgctgggattacagatgtggccaccacacctggtctattttatttttataattaaaaaaaattatgtggagacagggtcttgctgtgtttcccaggctggtctcaaactcccaatctcaagtgatcttcctgcctcaacctcccaaagcactgggattataggcatgagccactgcacctggccttattattttaacagatttttaaattttaacatacctacttccagaaataattttaggcttggcttgcaagccccttgagtggctggagttcaagtggtattcactgctggttttctcctagtccttgactccccagtggcctggcatgggcgctgttgagagaggggcacttttgaagtggcccgtggagctcaaggcagggctgaaccctctgcctgctccgcttcaggcctctggcccctggatgctgagctgctgctgcttcctgtcaacacagactcttctgtggatgctacagcagccagacctccctggcaccccccacacctagaacgatatgttcagaacataaaagaatatagtcattagtagaggtgaaaacaggttcttagagtgaagtgtgttcctcaggaaatcagcttcactccccagcacctggcttccctggttctttctggatgaagaaagacctttaccctacacgttggaagtataggtgagcatctcttaattaaagctaccatttgagaggaatatagcaaatcctcaatacctaactagcagaacagtgagactcttttgtgaagttcacacatgaccagatgatgtgatgatacagggtaaggccaacaggccctgtgccttgaagcttctttgcatatcggtccctccagaggtggctgctgtacactttccgcaactggtttgccatcgcatttcagctccagctgcatctgagaacactcaaatgtctctttaggtctttttaaaaaattgtgattaaagataacataaaatgtatcatgttaactattcttatgtgtacagttcagtagtgttaaatgtgttcacattgttgtgaaacagatctctagaatttttcatcttacaaacctgaaactctgtccccatttaacaactccgcctttatcctccccctaggccttggcagccactattctactttctgtctatgaattggctactttagatatgtcatataaatggaattatgcagtattcgtctttctgtaattggcttatttcactcagcataatgtcgtcaaagttcattcatgttgcaatgtatgacaagatttcctttccttttaaaggctgaataataatctgtgatatatattcacaaacacatacacacacacacacacacacacccccacagtttatctgttcttctgttgatggacacttgggttgcttccacctcttggctattaagaatagtgctgttggggctgggcgtggtggctcatgcctgtaatcccagcactttgggaggccgaggtgggcagatcacctgaggtcaggagttcaagcccagcctgaccaacatggtgaaaccccgcctctactaaaaaaaaaaaaaaaatacaaaaattagcggggcatagtggcaggcacctgtaatcccagctacttgggaggctgaggcaggagaatcacttgaacctgggaggcagaggttgcagtgagccaagatcacaccattgcactccagcctggggtaaaaaagtgagactttgtctcaaaaaaaaaaaaatagtgctgcagtgaacgtgggtgtgcaagtatctctttaaggccttgctttctgttcttttggatgtatacccagaagtattgctggatcatatggtagttctatttttaattttttgaggaattgccaagctgttttacaaagtggttatactattttccattcccaccagcagtacataagcgttccagtttctctacatccttgccaatgcttgttattttctctgtgtgtttttaaaatattcaccattttgatgggtttgaagtgatatcttgtcatagttttgatttgtatttctctgatgtcttcaggtctatttttatataacttcaaagaccttgaaactttctgattgtcacaagcatatcttttctgctcatccagtcaacagctgtgtcccccactatggtagatttcccaaatgaaaaatgcctgggttgaatgaagaagagtggggaaaaaatttagaaagaaaaataaaaaaaatatgtagaactgaggttcagcaaaatatgctaattgttagtggaactcaaaaaatagtgagtttccccaagcagttttatgtgtatagttcagtagtgttacgtatgtttacattgttgtgagatataagaagcgtgtgtgtctacaagttactattgatggtgtacacattttctcatcttgttgattctgctttgatcatggtttatagaacatcactaatattttgtgactgtaagttataatagcagattcttttatgtgtgggtattattttaagctcagggaccatttccaggtacagaatgtgattcatgagttaggaagaatgatagatgtgattgtaatgacatagcaaaggtttgtggtttcaggtctacaaatatagaccttagaacaaactgtagatgggccatttgacttgtggactctgccaagccacattgataaaataacttttctttaagccataacgtttcacaagagtctgcgctcacctcatccacacagtcagagagctcttggtcaccgcacttctcatggcaaggccccctcaggaatgggcactgggtttgcttgggaccttggcagaggcaagcatggggctgagcctggccccacagcactgcccctgggaggatcccttcacctttgtggcagtcattaacaagcatgcaggtctctggtcagcttccccaaattcttccaaggggtgcctgcattcagctgcttgtgctttgttttggcaaccctcacccacaggcgctaacacactgtccctcgcctgtgtccgggaggaacagaagagccagccttgaggaggtagatgctcattgtagggcttatttgaaaaattctgagtttacttgaaatgtaactggcaccttccagcgtaaggcagtattcagagacagttcttgattacatgacatagtgaaatttttgtaatattcagatttgaggattccttaccaatcaacatctttgacttatgtgtaaccaaacactgttacattatttgttctctatacatttccattttatgttagaaaatttgcttataaacagataaaacaagtaatttttaaaaatgacaattatgcaggaaaattatctgtaaacgttttttctttttttttttttttctgagacagggtctcattctgttgcttaggctgaaatccagtggtgggatctcagctcagtgcagcctctacctccaaggctcagatggtcctcccacctcagcctcccgggtagctgggactacaggcacatgtcaccacacccagctaatttttgtactttttgtagagacagggtttcaccatgttgtccaggctcgtcttgagctcctgggcaaacgatctgcccactttggccttccaaagtgctgggattacaggtgtgagctaccacgcccggccatgtaaactcacttttttggtttttttttttttgagatggagtctcgctctgttgcccaggctggagtgcagtggcgcaatctcggctcaccccaacctccgcctcccgggttcaagcaattctcctgcctcagcctccagagtagctgagattataggcatgcaccaccatgcccggctaatttttgtatttttagtggagacagggtttcatcatgttgatcaggctggtctcgaactcctgaccttgtgatccacctgccttggcctcccgaagtgctgggattacaggtgtgagccatctcacccataaactcatttttagaagtataaaagaacaatggccaataatggtggtaaataacaatggtattgggtggggaagtggggattctgtagaaaatccaatctcagaaacgctgttgcagttgagcgtaaaatgtaagtacaaatatcttgggcattcgatacaaaaagaacagtagcaactgcattgttttggactcttaagaagttctttgacttctgcctgatacttaaatccacaaaattatgccacagatatttgtgacaggtgagttatcttccttgtgagacaggtgacatgataattgccacctcctttctccagaattctttgaactagtgcatgctgaatcatgatgctgtcattgtcccaggtggactcacacagctctgtggtcaaacggcactgagccggtgctccttcctccatctccagccttctctgtcgctgcagctgcagctggcaggcgtggacagtcaccttatggtataatggggtctgtggtggcttccttcagctccatatcagcctggtgtgcttctagcaatggggcaagtggcagctctatctcctaggcccaggattgactgggtcagtgtgtgtgggctcccagccactccaggatgtggagccatgctgtcagcaaccttccatgcctgtgaggtttgttcctgggaggcctggctagacttggtctggatagcttttgtcagttgcacgctgtgggtcagcaggtccaaagggtgacttcagtatatttacgtgtccaagagttctctggccccaagtctttgttctgtgcctgattctttccatttcaaagaccttaaatgttttgtgtgttctttatagtgcccagattagatattgcaaaggtgtgggaaaccagggttggtgtgcaggaatcgcaggctcaggagcttgaatcctgtgggatctctatttttctatcctttaccactgaaaaggagtatatgggagatctgtggtgttgagtgggttgtgagaattttgggtgttgaaatttacaacgaggtatgtagtctgatgtcttctccacagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggtgggtttacctggtgatgcgggtgggtctgagtggtgtgttaaggaacagtgtttgctgtcattgtccacatgggcatggatttcatatgtggctgtgctgtcataatgcttacgaggtacaggcatcctctctcctggtgagtgattttctactgtattcccagcagtttatattctaatttctatggagatttaataatttctgtaatcaaagctatattcctaaatacctcaagtttttgaaacctcatcaaaataaagtttatttggcaacttagtatgtaggcgtgtatgtctaagagaacatatatttcagctgcatattagaccctatattagaacataaatttatttacttatttattgtagagaaagggtcttgctatgttgcccaggctggtcttgaactcctgggctcaaacagtcgtctcaccttggcctcccaaagtgctgggattacaggcgtgagccactgtgtctggccagaacacacatttaaacttaggtagtggaaaagagtacgtctctttgtggaaagcccttttgagtgataggttgaatttagcatctgtagtcctttcccagatggggctggagatgggaagagaggagaaggctgaaatgtgaagctgctgcggtggctgagctttgagtgcagagtaaatgacagaagggcagcagaggcaagctggcatttgaccccgtgcattaatgactgccctatggaccaaggtgaacacatgagaatgtcagaacaccaacggtggggacagtggtggagggagcagcaggaccatacattgtggtagccgttgttggaaggctcttcctcaggttatcactcttgcagggaagatcacaggagattttcattttctgtttgtatttctgtttaagtctgggggtcaaaagagggctcatggtataggtcaactgagatgtgtttgtaagaacaggcttagtctatgtacgagactgtgaaggccatgattagtagagccagtgtgggagcaaagccccacattcacctcctctggttttctcattgagggccaagaggagatagaagccccgagaggggaactgacttgcctgggatccacatggagtagtgacacagagcgagcccaggccttagcacaagaaaggaaaggagtgacttggaagcttttgtttccaacaccataaagaaatgcctgttaatctttagaaaccgctcctgctggaggcatggtaatgcagacagatacttatttatatctgaaaagtagaagcaatgtgtctaggtaataatggggaagctagttaaataaatgtgatagacaacatgaggttttgtcctgccattaaaaatgtttatgaagaattttaaggacatgagaaaatggcaataataaagttaaaaagcagcatattgaactgtatatatagttgtctgatcttcctgacatagtctcattaagggggaaatttagggtggatggtagaattctagagacaatgcacctgccaggttagataggggatgccagcgacacgactgggacagaaggagcctcagagagaggatggggtgagcagatagactgggcattgatctggagacctcaaacaagtgttttcccttcttctaggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggtaaatgtcagcttttaactcttgtgtcagatcctgggtgacattgtggttttaccttctgtatgctgggggcttctgaatgatgctttaaaaaaactaaaatttgcttacattagtattatttttagttataaccataatttgtttagtcagtctcctattggatggttagttaggtttggtttttgccatcctatactagcagtggtttgcaacttctacatacattaaatctggaagagttatagtaattaacactttgtaatagcaaaaactaggaacaacccaattgtacaccaacaggagcatgcataaatacattgtattatattcacacaatggaatattatacatcaatgagaatgaatgaactaaattacacattgatgaaatcttaagccagatacaagagaggacatgctatgtgattccctttgtatatacatcaaagcaaacaaaagtagtttttaggcatatgtgtaccagtgttaaaatgttacagaaagttggctgagcacggtggcttacacgtgtaatcccagcactttgggaggccgaggtgggtgcatcacttgaggccaggagtttgagaccagcctggccaacatggggagaccccgtctctactaaaagtacaaaaattagccgggtgtgtaattccagctactcaggaggctgaggcagaacagttgctcaaacccgggaggtgaaggttgcagtgaaccaggagtgccactgcactccatcctgggcaacagagtgagaccttgtctcaaaaaaaaaaaaaaaaattacagaaagcaaggattctcacctgctcgaatggcaacctaacaatttttacattatcacacacagaattgactttttcaggatgtatagtcctatgaattgtaacacacatatgttttgtttgtttgtttggttggttttgtcgcccaggctggagtatagtggcgcgatctcggctcactgcaacctctgcctcctgggttgaagcgattctcttgcctcagcctcctgagtttagctggagctacaggtgcgcaccagcacacctggctaattgttgtatttttagtagagatggggtttcaccatgttggccaggctggtcttgaactcctgacctcaggtgatccacctgcctcggcctcccaaagtgctaggattacaggcgtgagccaccgcgccttgtttgtttgttttttggagacagagtctcattctgtcacccaggtcactctcactcaacagcaactgatgcaattcttccaaatcccagtacatttcagcatcccattcagttgtaattctgtaaaacaactttcatccctcctgaatagtaactgctaaactgaaggttacttagttgaccgctttcattaaagcaggccttttgtagagtagcccaagttgaaatttttgctgttttttcttgatcattctagatttagttttacctacttcctctcccagaaggttgaagaaaaaagtggttaagaaggtgattaaatctggaagggttcagatgtcttcgaggataaaacaaagaaaataataaaaataaattttaaaaaattaaaaattaaattaaaaaatttctaaaaataaatattcttggaaggagatggtagattttctcacagtgagacttctgttcctaagtattctgttcgtgaatattctggcatagtggcatagataaagcttggatccaggtggcagtagagctggcagaatcggggatggggcctagcagaggctgcagctggcagcttgactcactcagatttggtgttccaaggtggagttcagcttctggtggtttaaggaatttaatgaccttccgtattcatggagattcattttattccatttttttcttttgttagtctacatatgttcttttaatggtaatcacagatattttagtatgtatacataatcaagtcagtcttttgtttttttttttgagatggagtttcactcttgtcacccaggctggagtgcaatggctcaatcttggctcactgcaacctccacctcccgggttcaagcgattctcctgcctcaggctcctgagtagctgggattataggcacacgccaccatgtccggctaatttttgtatttttagtagagacggggtttcaccatgttggccaggctggtctcaaactcctgacctcaggtgatccgcctgcctcagcctcccaaagtgctaggattacacgtatgagccatcacgcccagccataaagtctaaatttaatctttattttcttccagaacattcaaggaactcagaatgcattaacttcattcatccccttcacaatttatgtcctttttttttttgtcaagtatcttagttatatattttaaatgtacaaattaagaagttttactattttatgcaatcagtgtgtgtagattttcccttatagctaccagtatttttgttcatcattccatcttgtgttaaagacctcttccatctgggatagtcgtctcctcttatttaagtacatgtctttaaaaccccctttccttgaagatctcttctttcagttcttgtttgactgcagtgtctttattgctttctcagataggattagaatactaggtttacagttattgtctcttactacattgaagatacaaatcctagctagattgcatcatttcctagctcgcattgctgctattttgaagttggctgtcagtctaattgccgttcctttgaaggtgatcaatctcttttatctggcctctgggtttgtatcatttccctacagtgtttctagggatagatttctatttttacttgagatttgttgggtttcctggatgtgaagttttgtgtctttcaacaactctgaaaaattctcaattagtatctctttgtatagtatcattctctttattatctcctagatatctgactaaatgtatattagacctattatattctccatgtctttttttttcattaaaaaaattgtaaaatacacataacataaaatttaccattttgacttttctttttagtattaaagagatggggtctcactctatcccccaggctggagtgcatgattatagctcactacagccttgacctcctgggctcaagtgatcttcccacttcagcctcccgagtagctagactataggcgtgcgccaccaccattttgaccatttctgagggttcagctgagtagtgctaagaacgtgcaaatcattgtgctcgccataccttttaacatcttatgtttccttctcttaatctctctggctgtattctgggtgatctcttcacatctgccttccagttcacaaactcaccctccagctatgtttagtctgttctttaaccttttcattgaatttgtaatttcagttaactctttttttttcagaagtttatttttttgttgtttattgaaattgctgggacatttttatagtctctcattccttcctgtcttttatttctttaacacattaaaactttaggccaggtgcagtggcttacagctctaatcctagcactttgggaggccaaggtgggcggatcacctgaggtcaggagttccagaccagcctggccaacatggtgaaaccctgtctctactaaaaatacaaaaattagctgggcatggtggctaatgcctgtaatcccagctactccggaggctgaggcaggaaaatctcttgaacccgggaggcggaggttggagcaagtcgagatcacaccactgcgctccagtttgggcaacagagcgagactccatctcaaaaaaaaaaaaaaaaaaaaaaaattccttggcttcctagctctaattttcctcctgtctctgacctcctgttcatttaacaaatcgacccaccacgcccagcttggaaatgttcttattctcagagttgaaagcacagaaaaaataagaatggtcaagaaaaaaataggtgactcatgtccaaagaggctttatttcagtctcatccctgtcattagcagagcatcataaagtaagtaattacattgaaaacacatatttgttggtaatacaaaatagtaatcaacaacagagcaatctaactggaagtctgtatgtcccaagcattttgttttgtttgttttttgagacatagcagtcctttcctgagattcttctctgtgtggttgagcgtagaccaccttgagttgtagcacctgggtgatttccctagggctgccctagcaaagtaccacaggccagatgccttaagacagcaggcattcgttgtcttacagttctggaggctgcaaatctgaaatcaaggtgttggcagggctatgctgtccctgaatcctaggggaggatccttcctttcccctcccagcttcttgtagccacgggtgttctgtgactgtggcagcatcattccagtctctgtctccattgtcccatggccgtcttccttctgtgtctgtgtctaaattttcttcttcttgtaaggacatattggattaaggtcatattggattaaggacacaccctactccagtgtgaccttatcttaactttaattacatctgcaacgaccccattcccaatgacctcatgttctgaggtaccaggggttaggacttcagcatgtattttgagggaacacagttcaatccataataacacacaccttataaacaaagttatcatgcagtatcagggaattacacaattttttaaaaatataagaactctctggtcgggcatggtggctcatgcctgtaatcccagcactttggaaggccaaggcaggtagatcacttgaggtcaggagttcgagaccagcctggccaacatggtgaaaccccgtctctaccaaaaaaaaaaaaaatacaaaaattagccaggcttggtgaccctcgacccagctactcaagaggctgaggcaggagagttgcttgaacctgggaggcggtggttgtagtgagcatagatcgagccactgcactccagcctgggtgacaaagcaagactctgtctcaaaaaaaaaaaaaaaaaagaactttctgctcatctggcagtattttttctagaaatcagatgacatgctggctagaatgattgggtgggggtgggaggcatggaggagggtacagagctggagaggcagagacagtggggaaggatggaaaggtctgagggccatggggcagcatctaagaggatggtgggtatgaatttttagtggcttcgctgcatttttgtggaacttcttggtttgggtggaagatatttctgtataaagagtataaggaaaattgtcctgagacaaagattgttacttgttatgttttttcttatttaagtcattaattttttcttcttgatgagcattatttgagataaataatttgtttttaaaggacaaatcatgctaagactatatcataattcttgacatggtggggtatttgtggcagaaaatagcttctgtccttttttcttatctagacgaggtttgtggaaatgagtccctttcttggggagactctcagtaacttagtgataattgtttatgttacgcctcccagtgctgtgcgtgcctagactgtactgaactatttttggtatgcagcctaataaggttccttgtcacgactgtgtttaaatcacatgaaatactcaaatcatgttcagggttattttttccctgtttatgaaagaactctattttttcttcctactgtgggcacttgaatcttctgtaaatgagttggtcagatgtcctaagacctgtttttcacagcctcacgtcactggcattttggttttggtttcaatcactgtgcagggttttttagcctaatgacctcaacttgatgatgctattggtacttagtaatctaatgtttgtatttttgttcccttttttctttaggattcctggactccagagttaaagttgaagttgataaagtttctagctttaatatctaaagccagcaacacgccaaagcttttaacaatatatgtatccttttgaagcaaatagagaccacctatggttttagagcagattttatttagagttgcacgctggcttaggtttattgaggttgcctcattaaatcgggataattaatagtgttgctttcatatttacaaggtcaatgaatcattaatggcagggcctatagagatcaacttctatatcattggatctctgagactttctttttggcaaggtcttattttgatgtcacgtggctagaagttgtcttggtagaaaagaaagtttaccttcttgtaaaagaattccttgggataattgtccctttgcagaatgtcacttaaccacttttaagcccttcaggccatggcatatggatcgggtgaccatctaacttgtcattcaaattgggacttctttttaaataactttattgaggtgtaaatttacataccataaaatctacccatggtaagtgtacaatttaatgctttttggcaaacgtacagagctgtgcagtatcaccacagtccagttcaaactgggacacttttgaaagtaaaaaggggcactaactggacaaagtaccagggtgacaggtgtaaatagagcctgtttcagaaagagcagaacgttaggtcacccaacccatggaagactaatttcccaaaggttattagtttttaaagacaagtatctccttttacttggaataaaaatgtatccaaagttatttcataacaagaacataatgttttgaatggtaaaattggtcactgtttagtttaatttcatgaaaaatttaggctactttgctgcgtaataccttctgcttcctttctaactccaaagcatttgactttcttgacctaattgaggttttatttgtcactaggactccatgccacatttctacttgagcttcctaagccttccctgttgcctgtattcaaattccttagcctggcctgagccgaacggactgatctacagctctcgtctctgcctttatatccttaaggcttttgtttaaattcttctgtttgcctacataccacgatgtttgcatatccaaaccttttccttcctagagttccatatacagtgattttcagtgaaactagaacttttccaacttgacttataattatttgaatacgctttaaaaaagcatttctcagcttaatttttttttttcttgatactgctccttgtggaacagggctaccccataggcagtgtgcccagagtagctcagcttaataattatgggtgccaatatgttaagaatctaatcaaaatgatttacatggtaaattatattagttatattaaaaatatattagtatactcaaaacagtacctgactgggccccgtggctcacgcctgtaatcccagcactttgggaggctaaggcgggaggatcacttgagcccaggagtttgagcccagagtgggcaacatggcgaaaccccatctctgcaaaaagtacaaaaagttagctgagcatggtagcatccatatgactatagtcccagctatctgggggagacaggtgggcgaatcacctgagcccaggaagttgaggctgcattgagctgtgtattctgccattgaacttcagcctgggcaacatagtgagaccctgtctcaaaaaaataagaataaaaaaagatcatagtacctattttataggaagagtatgaagattgagttaatacatataacttgtatgaaacagtccagtatatagtaagtgcttgataactgttagctgttggcattagaatttttaagtacttgtcacctttcatcctgttccacatgctttgaagcatatgctgaaatatagcaggtaactataaataacattctaatattttccttgttacatgaaaatacttgtagttcagttcaatacattaagcttctactatgagtcaaatattgttctaggatttagggatataaagaaaaggccaagatgtaattctcttagccaaactggagctttgaacaataaaataggagtctgtgaggcaaacagaggagggatgggaattacaggtagagggaacagcctgtgcaaaggcactgagacagtgcctgggaaactgaaataatttaatattactggagcagagtattggcatagacaaactcagagactaggcagggcctaggtcataaaggtttatgccaagtcctataaggaataaggagcctttgaagcattttaagtaagagaataacagttgtatttgcaaaaaataactttttacttcctgattataaaatcaactatattccttatagaaaatttggaaagtacagaaaggtttttaatacagacatacacccaaattgtaataaaggtaggtacatgtatgtgtgtgtatatttctatgcatttttatcaaaggaagagaacatcttcccatatcattaaatagccttcaaaagcaggttaagttccctcagaggtttaaacgtagagttaccacatgacccaggaattggtccaggctgtacacccaagagctatataccctagctatatacccaagagaaatgaaacatacatatgtccacaaaacaacctgtacacaaatgttcatagtaacattattcataatagccaaaaaaatgcaaacaactcaaatgtctatcatcttatgaatggataaacaaactgtggtgttatccaaatgatggaatatcgtttgatatcatccagccataaaaaggaatgaagcactgattcatgctgtaacatgaatgatccttgaaagcattatgctaactgaaagaagccagtggcagggaccaggtattatatgactctattcataaaatgtccaaaagaggcaaatctggagagacagaaagtatattagtggttgccaggggctggggagagcagggaaaatgggagtaactgccagtgaatacagggtttcttttggaggatgatgaaaatgttctaaaattgattgtagtgatggttgcataactctgaaaatactgaaaaccattgaaatgtacacattgattgatgattgattgattgattgagtcagaattttgctcttgtcacccatgctggagtgaaatggcgtgatcttggctcactgcaacctccgcctcccaggttcaagcgattctcctgcctcagcctcccaagtaactgggattacaggcacccactaccaaacctggctgatttttgcatttttagcagagacagggttttgccatgttggccaggctggtctcaaactcctgatctcaggtaatccacccgcctcagcctcccaaattgctgggattacaggcgtgagccaccacactggcctgaaaggtacactttaaataggtgaattatacagtacgtgaataaagctattaccaaaatactaaggaaaagtttaagacaaattaagggaaaagaaacatgttaagtaactgtcttcagtcatgcagccagacgtgtgggaactgagatttgaacccaggcagtctggctccagagtctgtggtcttagcaatactgtgctatgctgttttcacctcaatatcaatttccttaggataaagctttgaattgaagttagagttgaattatgtataaaatcagatttgcatttttagttggcttggtagcagtggggaaggcctttggaaggggataggaaggggataggaggctgttgaaatagtgcaagacttgaattcagacagtgataattgaaatggggagaagaggacttgccttcttctgaaatgggagtgggtcaggccagtatggagaagttgcttagctatttacagcaacagttggagctggccctcccggctccgagaattctgtttcatcatgctgaggtgctttctcacattggccacaggatgtccgataccccaagtaccgttccctgaatgcctgttttcctgaacttctttttcatcccagaaggagaatggacaaagtaacaaaggtaaatcatctagatttaaatttgtctaagaacaactttgccagttcaggtttgaagtagtaagatcggtgcaaagatggagagaattcatgattttggctttaagagtctaaatatttatgaaaggctttgcagtcatagtgacctgcagttccttgaggcccattttcgggagggctggtattgttagcttcgtcttgcatgtcaggtagctaagccttggagaaatgaagagaatccaataacatcccaaagggaggtaactgcagcagcagcacattttccctagaaggtgtagggcagcatgggtaaggatagagttcttttaatttaatttattttaattattttaatatttaacttttaccttgaactagtcaactggggtcttcgaagacatatggagtacccattcttatcaagcattttccattcccaagtaggaattccagtcttcagtttgtagcatgaagtgttatttttccatggtcaattgtttttaccagaactgttcacttttgagtaaggtgagaaaaagtgtagttaatatgaagttggtggccccagttggggcgctgtacctcagttttgcctttgatactacgttttgacagctgcttaaatgatgatgctggaaagggcctgtgatgcatgtcatccctctggtgagtattgatggcataaccctcagttcccagtaggtggagtgtgactacaggagatcttgttccatgcgccagcacatttgccctttcaaagcagagtcatgccagagaggatttcagaactccctgccattgctttttcctgtttctttttagggagtgaaactcttttaaagaaaggaagcattaattagtaaattatttagctgtttgctcaccagggagttggcagataagcaatggggtttgtcaacctcagggagagcttgggtttgggtttgtcactcaagatggctttggcagcgtcagcctttgagaaggcttcggatgcttggttttgctcttggtagcctcaagcatccccagctcagctgttctaagtgtgtgactggttctgccagccatgctgacccttctgtcgctcagaggggacaggccctgctggcccttcatggaggagcagggctacagatacggccccatgggatcaacctggactgctccaagggtcgcaggagcaccctgagtcttggagctccccaaggttgccctacccccagtacagtatgtggaggaagactcccagcctgcatcctcagctctgcaggcccgctctctcagtgctagcctaggcccaggcctggccacggtgcgtcccgggccagtttgctcacatccaacacagctggcatcttcaactggactgggactttggatcttgccctgcagctcctggaaatacacctcagcccactgttccattgctgcctgacagaccatcccgacttggtggcacaaaacaatgacattcacttataatggtgatgatgagcctgcatggtctgggagctgtgggctcagttaagctgttctccctcagcgtgtctctcaggtgcagtcaggcggagcggcctggggccaactccaaggcactcacacgcagagtggtggtcggtgctggctgtcacgtggggtctcagcagaggcccttgacgagaacacctgcgtggccttgtggtctgggcttcctccaggcatgttgcctggtttccaagggtgaatgtccccagagagagccaggaggaagctgtatcactttttctaacctagcctctgaagtcagtcagtcatttctgctgcattctgtttcttgcaagtgaattcctaaggccccctcaccttcagagaaaggaaattacattcctcttcttgatgggaaggagggtgtgtcaaagactacaggcattttaaaaccaccaccataccctgcatctctggaccctagagaactgccttagttgttagttgaatctgccaggtcgctgttctgaactagcctttggacccccaggcaatgggggcaggaaggtggtgagaaacttctctctctggttcctgagtttctgcagctcatgtccccctagcatacactgcatttttgagcatagctttcttctgggagcattatgtaaatctgataagtggcccagttttgcagatcaaataaacatgggaaggggaatgcaaataaaagaattgtctttctctacaggtttttaatgttggaatttcagtaaggagaccagtttttaagccttctttagggtcaattttaactgagttttctggaagccaagcagaatggctgtggatttgagtctggcaagcaaagtgcatctgtggcggagtgaactctgtaatgtggtgttgctatggagattggagattcgcattttgggcccaggcatgacagtcatttgtcacccccttgtcccctcatcctgcagctaaggctgtaataaccaaaggcacagacatgcccccagtttaatttaattctagactcaggcattgttttaagtgaagtggttgcatgatatcattgttctgtgtatcttgataggaagttttcacggttaagtgagattaccagaagcttttaaagaagacaggaaaggcacttgcagcagaaacttctctcagaaggaattacgtttgaaatgctgtgtggaataaaaacaggttgacaatgtagtaacatcggattattattttcacctagtcacttaaaaaggatatagaaatagtatcttttggcatttctagcatgaattgattcaaccctttcagaatgagcagttgatcatttttctggagtttggagccctaaacagtattttaaaaagtaatgactcatattcataagttacattataactttcttcatccagtatctgtggattagcaaagtagcaaggaggtaatttttatctgaatacaaacaggaaagagtatatcattataaagacagagaggttaattttagcttttcatagtgggtgagaaaaacaattccatatttaaaagttgatcattttgtcttgagcagccaattaaaatctcatttaccctttaaaaaaaagtacagtgccctaagtgaagtagaaaagttaaaaaagaaagcttgagtggcgggggagagatttacatcactgttatgtcagtaattttggatatgaagagtctcaataaatttcactggcatgactaagatggttttattaaaataacatggaggttataataagacatctccattaaaagttgaggtcttgtcactaggcgtggtggctcatgcccgtaatcccagcactgtgggaggctgaagtgggaggatagcttgaggccaggagtttgtgaccagcctggccaacatagtgagaccctattgctataaaaactaaaaaaaattaaccgagcgtggcgacgtacatctgaagtcccagctactcaggaggctgagatggaaggatggtttgagcccaggagttgcagcgagctatgatcgcaccactgcactagtctaggtggcaaagccagactccgtctcaaaaaaaaaaagaagaggaaattgaggtcttgcatggcaaggcatcttggtttagttgttcttgtctcataaaacttttgacagggaaaatagaaagtcctgtttaatgctctgaaataaagctgatgtgtttgagctatcacccacgtagcttctagtcatggacaggtcttgtttgtagctagttaaggtatctgcaaggtgatgtctctgggtagcagcctctcctcctaaggagtatacagttgtccctcagtatctacaaggattgcttccaggacccccacagataactaaaatcaacagatgctcaagtcctttatgtaaaatggcatggtgtttgcatacaacctacacacatcttcccatatacattaagtcatctctggattacctatacctaatacagtgtaaatggtgtgtatactgttgttataccattttgtttacgacatgaaaatgatatgaaaaaaagtctgtatgtgttcagtacaggtgcttcttttcccgaatattttcaacctgaggtggttgaatccacaggtgcagtacccatggatatggagtgctgactgtatttgaaaatggtcacaaacatttcagccctattgcctgcttctctctttccaataggctgcaggcagttaggccttttatcccggagatgtgccacactttgaaattgtcataaattctgattctgggttcccaaggcaaaagttccacagataatctcttatgtttagtaaattgcagaatgaacttccggggggaagggttcctttgtgcagtccggagggactgctttggggacattcacattggtgacttgggaggtcattgagcctagctaatgggttttggtacttgattcatcatgtaccacttggtccgtgttgagaaagtttgcatagatgttctccaatacttacgactgcaatatgggattatgaatagtattctgtagaattttcatctttgaaagttttaacttatctaattttgaactctctatatatatatgaaaaactttatttgtattcatttatttttttgagacagcgctgttgcccaggctggagtgccgtggcatgatcttggctcactgcaacctctgcctcctgggttcatgcgattctagtgcctcggccacctgagtagctgggattacaggcgcatgccaccatgcccagctaatttttgtacttttagtagagacgggatttcaccacgttggccaggctggtctcgaactcctggcttcaagcaattcaatcgccttggcttcccaaagtgctgggattatagatgtgagccaccatgccccacctgaaaaaaaaattttttttttttgagatgaagtctggctttgtcgcccagcatggagtgcagtggcgtgatcttggctcactgcaacctcctgctcccgggttcaagcaattgtcctgcctcagcctcccaagtagctgggattacaagagtgcgccaccatgccctgctaatttttgtatgtttagtagagacggggtttccccgtgttggccaggcttgtgtcgaactcccgacctcaggtgatctgcctgccttggcctcccaaaatgctgggattacaggcgtgagccactgttcccggctgaaaaactgtaataatagcacgaatttaacacattcctttttttttttttttttttgagacggagtcttgctctgtcaccaggctggagtgcagtggtgcaatctcggctcactacaacctccacctccctggttcaagcgattctgctgcctcagcctcctgagtagctgggactacaggtgtgcgccaccacgcccggctaatttttgtattttttgtagagatggggtttcactatgttggccagggtggtcttgatctcttgacctcgtgatccacccgcctcggcctcccaaagtgctgggattacaggagtgagccactgcacctggccaaatttatcacattctaagaggcagaaggtagtgaccccctttccctaatgtttaaggagaatcttgataaatgattttcagggccattctcaggggagtcaagtactggatgtaaattcatgccaggtgactttttttttttttgagacggagtttcgctcttgttgccctggctggagtacaatggcatgatctcagctcactgcaacctccacctcccaggttcaagcgattctcctgtgtcagcctcccaagtagctgggattacaagcatgcaccaccacacctggctaattttatatttttagtggagatggagtttcaccatgttggccagactggtcttgaactgctgacctcaggtgatccacctgccttggcctcccaaagtgttgggattacaggtatgagccactgcgcccggcctttgccaggtgactttttaaagttatctttcaaaactgagatttgtggatgttgaataataataataattcattatcattgatattttgggtttttaattatttatttatttatttttgagacagagtctcactctgtcacccaggctggagtgcagtggcgtgatctcagctcactgtaacctccacctcctgggttcaagcgattctcctgcctcagcctactgagtagctgggactacaggtgcgtgcctccacgcctggctagtttttgtatttttagtagagacggggtttcaccatgttggccaggctggtctcgaactcctggtctcaggtgatccacccgccttagcctcccaaagtgctgggattacaggcgtgagccaccgcacccagctgaagatattttgggttttaatagtaaaaatattttacttctgtatataaacagtaatcaaacatgaaggtttttgaaatacaatttgaatgtaggtttttagaacacaaattaggaagaatggttaacttaggttatctcaaacctgtggtgtgcaccagatccatttgaggagtttgttgactatatagacattcagaccccactcagtgtctataaaatcagaatctctgggagtgaggcctgatcatctttatttgtgggtgattctgatgtatttcagagcttgcatgccactgctttaggatggaacctttctgccacttttaaaagttatctacttgtggccgggtgcggtggctcacacctgtaatcccagcactttggggggccgaggcaggtggatcacctgaggtcgggagttcaagaccagcctgaccaacatgaagaaaccccgtctgtactaaaaatacaaaattagccgggcatggtggcacatgcctgtaatcccagctactcgggaagctgagtcaggggaatcgcttgaacccgggaggcggaggttgcagtgagccgagatcacgccattgcactccagcctgggcaacaagagcaaaactccatctcaaaaaaaaaaaaagttatccacttatatagaaatgtatttacaaagtctttcacccctttccatgaaatgaaatagtagtaatagccaccactatataaccttctctaggtcagccattgtgctaggcatgttgagtgtctttttttaaatttaatcttcacaataacccatcaaagcaattattgtctccattttataggttaggaaatgagaattacagagttaaatattttatctgtggttacccagcaaaaaggtaatagagtagggatttgagcccaggtctttataattttaaaatatctctccatatccttgaaacctgttctacaatgaagacttcaaatattgtacagtacttggatcaggacaatagtgagttactctgggtttgggggcactgttacctcctttcgtccaaagtgtgactttcaagaaagagggaaggtggtatgggcaaagaagtgccaacaccgatgaggatttgcctattcctgccgagaccagggtggcttggcttcagtgtctttagggctgcccacggggggattccaagcaaagaatcctagagccttctaagctgcttgctgtaaggcctggtgggagtggttttatgctttatcaaactggcagaatgatggaatctcttctccttctggattcttgtttttcctagcaggagtcaagcagcccaaagttttatttaaaataaagaagtgtcctgcagatatgaattgtcccccagacaacttcataatacaaaaacagagaaaaagacacaggtttgattcaggcattttatgagctcagtatagaataaaacattctttttttttgagacagagtctcactctgttgcccagttgcccaggctggaggacagtggcgcgatcttggctcactgcaactgctgcctcccaggttcaagcgattcttgtgcctcagcctcctgagtagctgggattataggcgagcaccaccatgcctggcaaatttttgtatttttttagtagagatgggattttaccatgttgcccaggctggtctccaactcctggcctcaagtgatctgcccgcctcggcctcccaaagtgttgggattacaggcgtgagccaccaccagccctagacatgtttattttcttagacctagaagaactaaaagaaattgcatgaggttcagtcaagggaatagattttcttaggaagcccagtgaggattgggttgaacttcctgaaaaggaaattttaagtcagtgtggttacaaagcactatgtaaataaatgtggcataaaatagaagtaagtgtgaaacacaagtagtgtccagtttattgttacaagaaaacattctggcaataagtatggtagttctttgagaagaatacaattatttttcatattgtggatttttattgatgttgtttgttttaactgtcttcctagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatggtaaggaagatccctaattgtgtgtatgtctgtttggcaatgaagaaggcttataggcatggactatgttgatatggcaggtggagcctgcctctctccattccaagccagtggcgcctgctgctctatttccaaaagccaacatgcatgaaggagataaagctgatattttttactgtttttatcaagctgcttgcagtgttttacccatttttcttaacatactgtctgccatatctttatttctctactttattcttttttgtttgtttgtttttgagatggagttttgctcttgttgcccaggttggagtgcaatggcgtgatctcggctcactgcaacctccgcctcccagattcaagtgattctcctgcctcagcctcccgagtagctgggattacaggcatgtgccaccacacccagttaattttgcatttttagtagagacagggtttctccatgttggtcaggctggtctcgaactcctgacctcaggtgatccgccagccttggcctcccaaagtgctggtattacaaatgtgagccactgcgcctggccctttttaaaaaatatatttttcaaatattgagacggggtcttgctttgttgcccaggctgattttgaacacctgggctcaagtgatcctcccaccttggcgtcccaaagtcctggggattacaggtgtgagccatcacacccagcctctaccttattaatattagcaaaggataaattgtctggcaacagaaaaatatgtgctagcaaaaaaatgaggggcacgtgccctgctgtcatatagggaagccactgattttctaatattggttttgtatccagctacctttctgaatcccattaatcttgggttttttgatttattcttctgtgttctagattgacagtcatgttacatcaaataatatttgtgttttgcttttaaaatttatcttaacttttttttcttagtacattggctatggcctatgggatagtgttgaataatgtcatcatgggcatctttatctcattcctgactctataaagtacaataaaatctatttgtggacatacagattttttaaaaattgaagtaactgtagattcacactgcagttataaaaaataattcaggccaggcacagtggctcacgcctgtaatcccagcactttggaaggctaaggcgggaggatcacttgaggccagaagtttgaaactactctgggcaatatggtgagacctctgtcactaaaaatatacaattaaaaataaaattagccaggcatggtgtctcacacctgtaatctcagcactttgggaggctgaggtgggcagatcatctgaggtcaggagttcaagaccagagccccggccaacatggcgaaaccccgtctctactaaaaatacagaaatttgccaggtgtagtggaggacatctgtaatcccagctactcgggaggctgaggcgggaggaactcttgaacccggctggcagaggttgcagtgagccaagattgtactccagcctgggcaacagcgtgaaactgtgtctcaaataaataaatttaatttaatttaaaaaaagatgggtcagaggaggaaagctggactctttactagcctttctaatgtaaaagaaccgcgttgttttggtaaaagattgaaacagttcagagaagcgtgtagtaaggagcaaaagctccttcaccacaatgctgtagattcatttccttattgatgttcaagactgacattgtcttgtgtattattttagaacatttctctgcgtatgcgtgtgtgtgtgtgtgtgtgtgtgtgtgtgtgtacacacatgcgtacagcatttgtacccttagttgggatcatatgatgcattactcttctgaaacttggtatttctctttcgatatatcttggagatctttccatatgaccagatccacctcattctttttaattcttatacacaattgcattataagggtgaatcattatcagatctctggtgatgaacatttagattttttgtttttttgtttgctataacaaaaaaatgttgcagtgaacatccttgtgaatactgtacatcttgataaaattctaaaagtggaattgctagggcaaaggtatgggcatgagcattttgatagaggttgctaaattattcgtcctaaaatatcaacaatgtctactcccccagtagtgtatgagagtgcctatttctccacacacggcaacaccaaataggactaaactttgaaatctttgtcagtttggtaagtaaaacttggcattctgcatattttaatttagatttctttaattatgtatgaggctgagtatattttcatgtattgttcttggctatatgtatatatatatatatatatatatatatattttttttttttttttttttttttttttttttttggtcagtcatccattttctttcctcattctcctgttttaagcaagaaagtgacatgatcagattggcttgttagagaaatggttctgctagcagtttcagaagttaaaggaggaaacagtttcagaactgagggtttgatccaaagtctcaaaagccacagaaaactccagaagaagagacctgaaaagtatccagtgtttttgacacttagaagctcactggttgtgagctttgccacacgagtttccatggaggaacgcaggtggaaagttggtcacattgtattgaaagttgaaggtgggttgagacagtaaatgcaagcggttctttcaaggaccttggctgtaaagagaagctgttgagagggtgattgatagataaggatctagggtgaaaaagaagaagaagaaaatctagggtagaagacgggaaaggtatgtttttaatatgaaatatatgtgaacatgtttctagttgtagggaaggaataagtatagaaagaaaggttaaaaatacaagatgaaaaaggtatgtttttttgttcgtttgtttgagacagggtctcactctgttgtctagctggagtgcagtggtgcaatctcagctcactgcagcctcggcctcccaggctcaagccatcctttcacctcagccttctgagtagctaggactacaggtgtgtgccaccatgcctggctaatttttattttatttttattagagatggtatttcactatgttacccaggcaagtctcaaactcctgagctcaagtgatccgcctgcctcagtctcccaaagtgctgggattacaggcatgagccactatgccaggcctgaaaaatgaatgttgaaattttaatactatagaaatttactataggaattcagaaggaatggactcaggataatataggaggtctagccctgggatggggttcctttttctctgagtcacttcacatgtagctatgtaacaaagggtgacagacctctgccacaggatggacagagccttttatgtggctgaagcagaccagaagtttgtagcagataggcaggaggcccaggaggagagaaaagggcccagccctttccagctccccaggggtggagtagccctgcttcccacgcagtcctgggggatggccttcctcccatgcaagtggatgagcaaggggtgggagagcagccgcttctactgccatatggaagttcccccaggtggaatcatgaagctgcggaagaggagactattttcaattatcatgcctagaaaaaagtgtggaagggtgtacactttttaatagtcattatccgcagggattggtttgtgggggaagggtgggattcaggagaggttgtggtacttgtacattgaaatgagcatacattatttttttaaaaagaaaatagatgaaaaaaactccaagatgaccactttcgatgttgtatgtcaatcctgaattctcgtagctggtgagagaggcacaagagatgctaaaggagaatgcaggatccagcagcgttgatggcgacagcagctcagccgcacgttgtcgagcactggatagttgattaaaagcgtttccatcactcattcagcaagcactggccaagccacctgtcatgtgctaggcatatctgtgacctcatttacctgctcactgtggctgttacaataaaggtgtggaaagcgagaggcagagctgttggtcttctcgagtccaggacttgagccctgatcttcagttctgaagcttggctctctttcccccacattatggttgtccagtgactttgttacatgaatttaccaaagtggtttaggatctgtttattctacatgacagtggagatagctgaagtggagtcagttaatttgcagtctgatgtctcatgagcacacctgcagtgtgttagcaccttgttctgtcagggccggtactttcactcctcccaagagctctgatgttaaagcaaatgattatttttctggcttacatacctcatcatcatgccttacagaaagctgttgagagaccactctaacaattgccagcgtgcctcaggtgtccctcagtgagtttcatgccatcaccagatgtctttgtatcctccttgcagatcacccctgagtacctccagagcgtctgtgtccgcctgttcagtaaccagatgcggcagagcctggcgcatagtgtggacttcacgaggcctgggacggtgaggctctgcgctcagggcagggtgcccgtggtctatccccccaaatttaaaaagaatgtaactttaaaaatagcatgaaaaaataacatgcaagaggctgcatttaagctggcttttgaagtctagaaactcctagaaggaaaataaatctgtttttgaagagggtacagctgaaagctggcctcctagggagggtgaggagagaggcgtgttctgcctaccagttgcagccactcagtgggggttcccagggttggggatcagtaggagtggatggaaactttattctccttttttaaaagcactgccatagtggaaattgtgtggtctaaagcagggacactttttttccccctaactttttacttggaataattgcaaaactgcaaaagtagcacaaaggacattggtatacccttcacccagagtcacccgctgctagcattggccccttcctttgttgtgtctctacacacaagtgaacacgcacacatatgcacaaaatctgttttctgaactatttgaggataaattatatatattatgactctttactcctaaatacttcagtgtgtatttcttaaggttaggaatattctctcatataactatacagttaccaacttcagtaaatttaacattgatacagccttcttatctaccgtccattttccaattttggtagttgagtcaataatgtccttcactgcatttcccgtcctctggtcatctagggtcaattgtcacattgagttggcacagctcttagcctcttctaatcttgaacatttcctcagcctttctttgagttacatgacattaacatgttagaagaatataattttccccctttaaaaaaaatagaacattttgctgggtgcggtggctcacacctgtaatattccagcactttgggaggccaaggcgggtggatcacgaggtcaggagttccagaccagcctggccaacatggtgaaaccccatctctactaaacatacaaaaattagccaagcgtggtggtgggcacctgtagtcccagctacttgggaggctgaggcaggagaatcgcttgaacccgggaggcagaggttgcagtgagctgagattgtgccattgcactccagcctgggggacaagagcaagacttagtctcaaaaaaaaaaaaaaaaaatagaacatttctccttttgtgtttgatatttccttataattagattcgggttatgcatccctgaatcacctaggccaaatacgacgtcggtgatcgtgtgtcctccttagactagcacacctgaaggcccatggttttgaggcaggcattcttaaccaggagagacactgttgtctctcaaagtcttcaaagtacaggaacccacgggccaggagctcacaccaacctgctgccccattcacaggctgcgtgggtgaagccctgtgaagccagctgtatagatttggaatgaggctcctgtgtgatcctgagacagccctgtgggtcagagccacagcttttaagtgagggtttgcacattaatatagtattagagtcttaataaacagaagcctttcttttagtatttaaaagaaaatttataccctacctaattctcaagtagatttgaagaagtttattataatatgagaaaacataaatatgagaaacgagaaggtagaaaataaaaataagtaaagcagttgtggttaagggaaaataagggtggaaaaaataaaagtcagcaagggctaaggctggtacaaaaaatgcatatgctgtgagctgcctctccggagaggcaggctgcagactgggctctgagctttccagcagtctgtgcaaaaagggaaacaggagcagttacatgattcccagtgcttataaagcaggagagggcagttacataacttttattatgtaatatttcctgcatccaaaacaacatatgtgctgcatatgcaggctaggaaccatgacaataaaacaaacacccacaagtccgccacatgtggctgaaatagaccatttcagtgctgctaaagttttctacccttcaggcttcttccaagtaggtgtgttacttatgtaatttaaaaacaagttcaaatgcttttttttttttttttaaactggatggtcagacaactgcttcacacagttattcctggtgctaagacccgggataatctcttgggtcagcagtttgtatggatcttcatagaaggcacgtagtcatgtgctgaagagcaggcggccttgaccacttcctctcagcctaacaaatatctcagaatggctggctgtcagctgttccacacacgtggacagacagatggtagaagcggagtctttgggacatggccacagtgattttagtgtgccaaaatcttagagaatcagccatttttaaaaggtcagtaaagtcaccattggatatgcaagtcttagaaaagtaacttcctcatgagcccctcagaagaaggacttgaagccacatccccgagaatatggctgaccctctgtccactgtccagttaacattcggacagttaggaagcagagtgtgcttaccaaaactgtggctttctcatagcaattagcatgacagggtctgtctactaggagcactcctttcttcctccttcccatttatttgttaattcatcaaagacttagtgttttctaggttcagtttataaaatcccattatatcttatatataccagccatccttacattcccatcttctataggaggagtgatgtatccagtttatttaaaactgatgttggtcaggcatggtggcgcacacctgtaatcccaacactggtagtccaaggcaggcagattgcttgagcccaggagttcgaggccagtctgggcaacatggtgaaaacccatctccacaaaaaatacaaaaattaggccaggcgtggtggctcacgcctgtaatcccagcactttgggaggccgaggcgggcagatgacaaggtcaggagatcgagaccatcctggctaacatggtgaaaccctgtctctactaaaaatacaaaaaaattagctgggcatggttgcgggcacctgtagtcccagctacttgggaggctgaggcagaagaatggcatgaacccgggaggcggagcttgcagtgagctgagatcacgccactgcactccagcctgggtgacagagcaagactccgtctcaaaaaaaaaaaaaaaaattagttgggcttggtggtgcgtggctgtagccccagctactcaggagcctgaggtgggaggatcacttgagcccaggaggttgaggctacagcaagaggagatcgcaccactgcactccagcctgggtgacagagtgagagcctgtctcaaaagaaagaaaaaactgatgacatgttattaagcacggtttaaaaaggagcaggggtacaacacagctggttatcccacaagaagttatcaataccatctgtcaggagacagtcctaccaccccgactgttatgttagcagcaaaatacagactttgtctaaccactggaaaccagaggagggaggatgagttatgtttagcttagtgataaccattctccttctactgaatcattggcttaggaacacgcaataaaagctgcaaaagccttttactgtttctagccgatttctttaacaagatgataaaaagcgtatggggggtcattgtcaaagtataagagagtattgttgttgactagacatgcatatataaagttgatttatgatatgtgtctcgagttcagatttacaatgtgtgaagaaggaaattaagaaacagtttagatgcaatgtccagtgactggactgataggatttaggatttggaaggagaagaagattgcttgcttttttgctgatttttttaaagggataaattctactctagggcccaacagaaggccatcaatttcaaaataagtacgtggcacagatcagcgtccttcatagagcggtcttgggtcagctcgccgtcaggtgctctgttgagcttgagtgttactgctaattacattctgtaaaggagcttgggctgggccctttcacaaaaccgttgatgtctataaagtttggtacacttgatactggtttttatatctggcagttaacaagaatctgggcttctaccaacttactcactgttaaaaattcaaaagggcccattaaatcgagcccttctttccccctgagttctgaactggttgaaaaataggacaaaagagtaaaggaaaaaggagctgaaaatatcactgttggtactgacaaagcttatattggagaatgtggatcttttttttttttttttttttgagacagggtctcgctctgttacccaggctggagtgcattggcacgatcagggcctctgctgccttgacctcctgggatcaagtggtcctcccacctcagcttcctgaatagctgggactatgggcctgcaccaccatgcccagctaatttttattttttatttttgtagagatgaggtctcactatgttgcccaggctggtctcaaactcctgggctcaagcagtcctcccactttggcctcccaaaatgctgggattacaggtgtgagccaccacacctggctgagaatgtggattttgtttgcaggcaggtggggtcctactcttgtgcctgggaattacggaagcattcttgcacagccctggacagctctggccaagcctagcccgctgccattgctgtggccaccatgagggcggcatggaggagcggagttgacacgtcttctctggtgggctctgcccaaagcagaagaggacaggcagggcagtgatgcccaggtctgcccccagcctcacaagtcctgttagtcaccgcctctctggagaggaagtctcccactgacagagcagctcacggtagaaacaccacaagaggaaagaagtgaggttctgccctcacctagttcacacccaggtagctgtgttcagaaagctgcccgtgttatcgaagctggcacaggtgtctaggcactcccagagggtttataaggacggtattcatttctttgaggcgagagctgtcccaggtggcctttttagtttgactccgcgtattgctgctcccacccatttgtctttctgtagtccttaccttatcagagcctgtggcttgctgggatatgggagaaatcagattttatattatcatcaacttagtgataagaagtaagggagaaagttatccctcagggcacaagaggctgagttttttgttttctaagattacgcaagtcacgcgggtgtgttcgtttgcagggaacgcagtgctaggctgttcctggatgacagtctgctgtcggggtttcacccatggcagagcagctccctggctgtgatctattgaaagtcagccctgggcagaaggggttagtgttagggttagggctagcgttacacaaatatgttagctagaaagtataccattttatctgtaaatgaaggaaaacccatcccctcccttcgctcagcgcatcctgccctcccgtgggaacctgttgcctgtgtttcatatgcgtccttctagagccttgaagtatatatcattaacttttacttgtgtgtatattttctttatcttctagagttctaatttgagaacggcattcctctatcagacatttaggtggcttttctgttttctgctgtttgtaatggtgtagtatgcattttccctgccaagagcagttgaaagtgccttggttggtctttctcttcttcaccccctgttccccctgggcaaatgtgaatgcagagacactggagaaaaggtatgccacgagagggggctgttccacccacaccaagcctgttccacccacaccaagcctctgccctaagagcaggagtgggtagaaggcaggctgaccaggagacagaatctggtgccaactcctaaggtagaaattcgagctcctgccccctggatgagtcccaagtctgacctagtggcacctctgggtttctggattccttggatggggaggtttccatttaaatgcatccttatttagaaagatgcccatttgagaattaatgctctttttcttcaacaactccagataaggccccattggaaataaaagtcaaaacactttatttatttggcttttattttaggctcagcaggtacatgtgcaggtttgttacatgagtaaattacatgtcactgggatttggcatacagatgatctcatcacccaggtagtgagcataatcctgagagttagtttttcaaaccttgcccctcctaccctcccccgccaatagttcccagtatctgttattctgatctttgtgtccttgagtgctcagtgtttagcttccacttagaagtaagagcgtgtggtgttaggttttcttttcctgtgttaatttgcttaggatgatggcctccagctgcatccatgttgctacaaaggacatgcttttgttcttttttatggtttcgtagtattccattgtatatgtgtaccacattttccttatccagttcactgctgatgggcacccggattgattccatgtctttgctattgtgaatagtgctgccatgaacatatgagtacgtgtgtctttttggtagaacgatttattttcctttcagtatagaattgctgggtcaaatggtagttctgtttgaagttcttgagaaacctccaaactgcttttcacagtggctaatttacattcccacgaacacatacagagctttttttgtttttgtttttgagacaaggccttgctttgtcgcccaggctcactgcagcttcgacctcctgggctcaggtgctcctcccacctcagtctcccaagcagctgggactacagatacatgtcaccacacttggctaatttttttttttttttaagaccgagtctcgctccatcaccaggctggagtgcagtggcacggtcttggctcactgccagctccgcctcccgggttcatgccattctcctgcctcagcctcccgagtagctgggactacaggctcccgccaccatgccctgctaattttttgtatttttagtagagacgaggtttcaccgtgttagccaggatggtctcgatctcttgacctcgtgatccacctgcctcggcctcccaaagtgctgggattataagcgtgagccaacatgcccaaccttttgattttaatttgcattaaaatggttttgattttgtgatagagactatagcattaaatgtaaaaagacccaggacatgtggctcttataaggcacctgcttccacctcagccatctttgtcagcagcttcctgctatgtggcttgtggctctggcttgaagctcagcatcttcagcccttgccttctccccagtgtgattttcttacatcttggcaaatgcctacgctttccccacattgctgccatgtgtccaggccatcttccttggtgcaatgccctgtgtattgaggagtctcccaaccagcacccctgaccctgctatacctcgtataccaatgcctgttgcatacccagaccaacctggtgatgagagggtttaacacctttgtaggccgggtgcagtggctcacgcctgtaatcccagcactttgggaggccgaggcaggcagattacttgaggtcaggagtttgagaccagcctggccagcatgacaaaaccccgtctctactaaaaatacaaaaattagccgagcgtggtggcacacacctgtaatcccagctacttgggagactgaggcacgagaatcacttgaacctgggaggcagaggttgcagtgaactgagatcacgccattgcactccagcctgggcaacagagcaagactctgtctcaaaaaataaagcacctttgtattaatatctcaaccagtgagttagagctgtgaccagccatcagctgagacctttctcgagctccaaacccagacttctggcctccccatgaatgcctgacagcttcaccagatttgtgtccaaatcgggctcaacttttcctccacacaggtggtctcccctcctgaatttcctgtctcagtgaaagacactccagggaacacctgggaagcgtctgaggtttttctctgtcctttgcctggtaatgggatctgcaagagcttcctccctccctgcccacattgctgttgtttttgtgtttgttcaggctctccatagttccctcttggcttaatgtcacatttcctaactggtcttaaagctcttaccttactgattatttgtcacatgggatctgaagtggcctttctggttgtgtcttgtttatttgtacccttcatgttccaggaaggactcaggtgtcttacaggcatccgatcatattactatcttgctcaacaccgttatcaccttagggtgaagtggttttcatctcttttaacgtgcaagtgccccttctcgttaaaaagctggcagggccggacgtggtggcttacacgtgtaatcccagcctttgggaggccgaggcgggcggatcatgaggtcaggagttcgagaccagcctgaccaacatggtgaaaccccgtctctactaaaaatacaaaaattagccaggcgtggtggcgcacacctataatcctagctactcaggaggctgaggcagaagaatcgcttgaacccgggaggcggaggttgcagttagccgagatcatgctgctgcattccagcctgggcaacagaacgaggttctgtctcaaaaaaaaaaaaaaaaaaaaaaaaaaagctggccatagcagccccttccgcatctgatggggatgtgcctctggcttgggcctccatcgcctgcccagtcccctggctgagatattgcctcaagggttccattgtgggcatttgaacctctgttgagttcaaggggccctacattccttacccacgtgcatcctgcacagcctgcccagccacagtgctctgttagtccaggtgagtagggagagaagaaggggttggcagaaatggcctcatcttcaggggctcactggtagcctctcctggggtctggcccccaaacttactttctgcccctcactggcccgcgcacccctgccccatcctgctgctgtctctacttagagcagcgttttccaaagcctgtgcccgcaaatgcccatcccgcaggatttccctgccccacagccaaacagcctgggagttaataagcttgtgaactgccatccagtgagattcccagcacagcagtacacaggagactcccgagaagtcccgcgggagaactgctacccctgctgagtccagtcagtctccagttagatcggacccaggaacactttccttaccttacacctcctgctggtttgtcttagaaagtccccatcctgctagtcaccaagagctgtcccaggcttggtgtggccccactgcccacctccccacatcctgacaccagctagggagagcagctgctctgggaggcaggccccaggtcttcctggggctgagaagggatggatgggggcagaaatgcagctgtttcagcttggcttaggtaggcatttatttttcctacccaaaggttccagagaacctagaagggagcctggcacggggcaagtgctcagtgaataattgatgggttactacattagttgttccactgttcttcacctgcatcctaaaaagggttgcgcctgcatttgacccagacatcttcagatgggagcataccacccacccgtgcacacctccacgggagggagaccaccgcccacccgtgcacacctccacgggagggagaccaccgcccacccgtgcacacctccacgggagggagaccaccgcccacccgtgcacacctccacgggagggagaccaccgcccacccgtgcacacctccacgggagggagaccaccgcccacccgtgcacacctccacgggagggagaccaccacgtgcatttgcaggtccactgtgattgggagcacagtcctttttctgatgccccaggcctgccaggcctttccctgagctctcagcctgaaatcctagaaatgagacagcactcacttgggctggagtgggctggagtcagagcctccgtagcaggtggagtccaccccgtgttcagaacccattgttagctcagtgagggaaatttttctgactggtgattggtgattctgactgtgttggatggtttggggcttgtgattgttgatgtctttgttgtagggctgtctgttgcactgtaggttggttagcagcattcttggccgtcctccattagatgccagtagcactactcccgctattaacaacccaaaatgtctccagacattgccacatatcccctatgggcaaaaccactcccagctgagaagcactagagggaaaggaaacatggctagtgcacagtgtggaaaatgctgccactcacactgcagagaacgcaggggatgctgaggaaaatcagtgccggcccatgctcccagaggggagggtagacggtgatgctggaaatggtccctgagagcatggaaggccagggaagatcggagctatcttggaggatggggggtgaaggaggccgaagagagtgaggggctgccagggagaggagctggtgactaaagccttgcgggggcctgggttgaggctgagcagatgcgatttttacaaagacccctgtgttgagtgtggaaggagggctggaggagagacctgaagcaggggagtgggcagagcaaatgtggactttgggacccgactgcctgattagattcttgttctaggggaagttgctcagtccctgtgtttgctgatctgaaagtggaaatggcagtgcatgaaatgagttaatatgtgtaaagttcctacagtggcatgcctggtgactagtgagccctcagtaaatgtcagtgagtacatccttattaagctaaggtggtagttcagaggagagaagaagtcctgaatggagcccctggcatggggattggagagaaggtagcagctgtgggatggaatcagtaggacctgatactttgggagatgtagagagtgaagaggccacttttttcttttctttttctgtttcttttcctttttttttgagatggagtctggctctgtcacccaggctggagtgcagtggtgcaatcttggctcactgcaacctccgcctcccggattcaagcgattctcctgcctcggcctcccaagtagctgggactacaggtgcccgccaccacacctggctaatttttgtatttttagtagagatggggtttcaccatattcgccaggctagtctcaaacacctgaccttgtgattcacctgcctcagcctcccaaagtgctgggatgacagatgtgagccactgcacccggcctggccactcttaactaatttaattccttaacaatcctgtgaggtaggtactgctggtgccaccattatgcagatgaggaaactgaggcgtggggagttattcggtcatttatcctcctcattggattgtgagtgctctgagaagggcatttgctttcttcactgcgtatcactagcgcatagcagagacctggctgatgggggcagtcagtaggtatgctttgcttgccaaatgcatgaaatactgcagccttctctccttattttattatttttttttgagacagggtcttgctctgtcaccaaggctgcaccgcagtggtacaatcatagctcactgcagcctcaacctcctgggctcaggtgatccttccacctcagcctcccgagtagctgggactacaggtgtgcaccaccacacctggctaatttttactttttgttgagatgagtctcactgtgttgcctggctggccttctctcattgagagcatgctgagccactccttctacagccatctccagctttgtttattttattagatactaaagttgtaataatgtttatcagactggctgtactcatgaaagggccaattattactgcttttcaaccagtttcttcacagggcaaatagaatgatagagagtttagcaaaagagtgttttaaaaggtagaaaacgttttttggctacggaaaaaggagaatgttgataaatttcatttgtggaaataaccagccaatatcactaattatcaagtatttttctttatatattatggtaatattttatttatttttgagacagagctttgctcttgtcacccaggctggaatgcaatggcacgatctcggctcactgcaacctctgcctcactgattcaagcaattctccttccgcagcctcccaagtagctgggattacaggcgcccgccaccatgcccagctaatttttgtacttttagtggagacggggtttcaccatgttggtcaggctggtctcgaactcctgacctcaagtgatccacccacctcggcctcccaaagtactgggattacaggcatgagccaccgctcccagccatgctaatattttagtatggccatgtccttacttgacccgtctgacttgttatcttagcttcttggtctctgtaaggtgttaggtgaataatttttttcttttttgatacagggtctcactctgttgcccaggctggagtgcaatggtgtgatcttagctcactgcagcctcaacctcccaggctcaagcaatcctcccacctcagcctcttgagtagctgggaccacaggcacgtgccatcacaaccccctaatttttttttttttttttgtagagatagggtttcatcatgttgctctggctggtctcaaactcctgggctcaagtgatcctcctgcctcagcctcccaaagtgttgggagtacaggcgtgaacggctatgcccagctagatgaataatttagatgacatttcaaacttattttctaaactcactatttaagccaacaacaggaataggtaatttctttattaaaacaatcaagggttaaaaagtataaaaacatacatgcatggtctgagccacttttttaattttagtttttattttcattgttttttgtttttgtttttgtttttgtttttgtgttttgagatggagtcttggtctgtcacccaggctggagtgcagtggtgtgatcgcagctcagtctcctgtgttcaagcgattctcctgcctcagcctcctgagtagctgggactacaggtttgtgccaccacgcccagctaattttttgtatttttagtagagatggagtgtcaccatgttggccaggctggtcttgaactcctgacctcaagtgatttgcctgcctcggcctcccaaagtgctgggtttacaggccggggccactgtgcctggctgatctgagccatgtaaaagtggtgtttggctgggcgcggtttggctgggttgaacccagtaggcggaggttgcagtgagctgaggtcatgccactgtactccagcctgggagacagagtgagactgtgtctcaaaaaaaagaaaaaaaaatgttatggaccagagttgggcttctccaagtttattgtgcaggcatgtccgctggggacctggctgaagtgcaggttctggttcaggaagtctgggatgggacccaaaattctgcatttccaatgagagctggatgatgctgcttgtctgaggagcacactttgagtagcagggggctgcagagtccagaaacaaacctaaggatagatgtatacctagcagacaacagaggtaggaaaggggtggtttatttcatgggtcacggagtcagatgctgtcagggctaggaagtgtgtaaagcagctggtgtcaggctgtagggagctctggggcctgaagatgatgttccttccaccttagtgttcacattctaatttaaaaaggaagaacaaaaaggaggtgaagaaaaagatagggaggaagcaagacttactgatggaagcattttgaggtgatgttggatggcctgggtgggacttacatgacgcagcacagctggctctcggggaacaacaaaacaaagttgcatgcctcattcacaccacagaggaaaatacagtagcatgaattccagaaggatgaaatctctaaatgtaaaaaataaagctatgaaaatgttagaagaattgagagaatgtgtgtatcatcttgaggtagggtagaccttcttaagcaagactgaaatccatgaaaacaatctggtatcacataaggcatgaaggcaaagtcaaaaagcaggtaatgtctatgaaaaataatggccaatatcactaaagtttaagaaagtaaactcttttctacccttcgaattgatggaagttttagagtgataggctccagtactgataacgaaaaaggaaagctttccttcagtgcggggtgtctggcaatgtttatcagaattgaaaatcacataccctttgatctagattttggaagtctagcttagctcataaaacaaaatatcagtaagtacaagcatggtggcgcacacccgtaatcccagctactctggaggctgaggcaggaggattgcttgagcccaggagttcaagaccagtctgggcaatatagtgagaccctatctataaaaaaaaaaaaaattgaaaaaaattgaaaaaaattgaaaaaaatttaagtatcattaactgacaataagatttttaacaaggcttctgtaatttcatgcacacaggggagaatcataaaatggatccccaagtgcccatcacccagcttcagcaataaatggcatttcactaatcttgcttgctttcttctcctctacttattccctgcccccaccctggagttctttaaaagccaattccaaacatgtcatgtcacctgtaaatcattcaatatacatttctaactgatcagaggctttaatatacaagcacatagccacaacaccaaatacagttaacactaattccttagtatctaataccagtccactccatattcaagattttccttattttctcaaaatatctttttacagttggtttatttgagtcagttcaaacaagcactacacactgtatctgcttatatgtttctcagatgtattttagtacataatacagcactacctgtagtggcaaaaagaaacacacacacacacacacacacacacacacacacacacacaaaataaatgggacaagaatctccgtaaagtaggtgatgattttgcctatggacaggatcaggattaaaagagagtggggtggaagaggggttgttaatgttttttaaacacgtgtagaaaatgtttgacttggtacaaagtgcacatttttatacttgaagagaaaatcttaataaagaaaaaaaccagaataatataatgattcatattgcttttgttcttcacaatgtatttaactaggcagtttgaaatgcccctgggagtttggtcagggagaacccatcgttttccatagaggatttttttttgtttggttgtttttgttttttttctaaagaaaataaaggaatcaaagaatggttactccgtaggcagagcagcctctagagtttttcttggagtggtgtaacatcaaaccagggctgggtaggctgtgagctggattagtggtgtgtaactttagtttgggttgatttttacatcgtatgtgactttggttggtgaatcctggtggattaaaactttgcacatctgggccaggcgcagtggctcacgcctgtaatcccaacactttgggaggccgaggtgggcggatcacgaggtcaggagattgagaccatcctggctaacacggtgaaaccccgtttctactaaaaatactaaacaaaattagctgagcatggtggcaggtgcctgtaatcccagctactcaggaggctgaggcaggagaatggcgtgaacccggtaggcggaggttgcggtgagccaagattgcgccactgctctccagcctgggtgacagagcaagactcagtctcaaaaaaaacaaaaacaaaaaaaccgcctctccgccagaccgccgccgcgccgccatcatggacaccagccgtgtgcagcctatcaagctggccagggtcaccaaggtcctgggcaggaccggctctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttgcttgctcgctgggtcttggatgtcgggttcgaccacttggccgatgggaatggtctgtcacagtctgctcctttttttttgtccgccacacggaattgagatgctcctttaaataaagcgtttgtgtttcaagttaaaaaaaaaaaccaaaaaaaaaaacccaaaaaacctaacttgcacatctgttgattccatgctattagggtgatttgggatccgtgcattgctatcagtgtttaacaccatctgttttcttctgtcctcttccccccaggcatccaccatgttacgagcctccttggcacccgtgtaagtaactgctcttaggaatttttattaaggagaacagcaatgtgtaaaacgggaattcaaagtgtctttaataaacacttagcagcctaggttagaggaatgcctttgagctagagctacatgtgaatattaaaggaaatacgagtacttataagtaatgttgttaaactagaattattttttattgcctgtgtggtttttttgtttgtttgtttttttgagacagagtttcgctcttgttgcccaggctggagtacagtggtgcaatctcagctcaccagaacctccgcctcctgggttcaagcgattgtcctgcctcagtctcccgattacaggcatacgccaccacgcccggctaattttgtatttttaataaagacgggttttctccatgttggtcaggctggtcttgaacacccaaccgcaagtgatccaccccctttggcctcccagagtgctgggaatataggcgtgagccaccgcgcctggccatcttatattgttaattctattcttttggtaaggaagcctcaaacaaaaaaacctgttgaattgttcatatggtattgtatagaagtgaatctaatctgctatcatagtgcaatccacagagtgttgcactgtctgaatttatgttgtctgctggttcacactgtgatcaaggccatgggcagccctgtgtatgcctgagcactcctgtcctgatgagttgggctgtcccccttacgagtgtctgatgctgtggtggcaaggaagttgagaacctttgacttgggcatgaggaccagggtggcttctgggaccctctgagccagctttgcgggagaggaggggaagacgggtgctgtgtgattcctcacacacctgagatgcccacagccttcctcctccctcagccctgcctgagtctgaccttgaccccacgctttattctctcctaccactttggcagcagtatcactgcacagactgctagggttaaaagcccacccctgctaccctccctgtgactggggattacttgtttaatttctctgtgcctcagtttcctcacttacaaaatgaggagaatcatagtaattctattataggattattgtgaggatcaaaattagttaatacgtatacaacacttagcatttggcataatactgtagtattacaccaaaattaggaaactatcattgatacagtactgtgaactagactgcaaacctcatttagtctcaccagtttttctatgccctctaatcttttctacaataaaacaacaataaaacaaaacgtgaagacgcttgttttagcgacaaggaagctgaggtgattccttttgtttctggctgaccgaaggtgggtggcagggcagtctgagctgtgtggatctccaatccaaggtctctcctcactgaaacctggctccccagaggtctttggagtctccctgaggagggtctgcaaattgtcctacaacccatctcctgcctatgttcccatgctgcttcctgaccacaccttctacctccttggagggctaagccacccacctaattactctttttttcttttttttcttttctttgagacggagtcttgctgtgtcttgcctagaccggagtggtgcgatctcggctcactgcagcctctgcctcctgggttcaagcgattctcctgtctcagcctcccgagtagctgggactacaggcgcgtgtcactatgcccggctaattttgtgtttttagtagagacggggtttcaccatgttggccaggctggtctcgaactcctgaccttaggtgatccacccgcacaggcctcccaaagtgctgggattacaggcctgagccaccacgcccggcccccgactgcttactcttcacacttgtttcctgactgttgttcatattcccccggtccagtagctcaggcttgagaggaacagtggcttcaggtgtttaggtagaactcttggggcctgctgatgctaattttctttgaattatgtccaaaattctaaacagaacttcagtggaaagtcatgatgccctcaaggtgatttcttccctatgctagggaggtctggctgaaggtgaatgtaggggtttctaaatctgttcaggcaaagactccttgttttaggaaaaatgttaaacagaacctaagtccatccaacagaataggcagagctgagctggttgaagctgaggtaggagcctagaacccagcccgccctccaagtggaagccgggaggtcatgctgggagcccatgggaacagcaggctctagcttgggtgtcataatgctcaggaggtgtaataaacatgcccttttgcccttttctttctctttgaacttgtgttgctgagtaggaaattgaaggatgtcccattactgccctccttggattatgagaaactgaagaaggatttgattttggggagtgaccgcttgaaagccttcttgttgcaggctctgcgctgggtaggtacctttgtcttaaagttagaaaacaaaaccaaaccagtgctggttttcttggctggctaccttgcttatatcttttaacccatcttccagaaatctttcttccccgctgtctgctgacaccaagaacggaagtcaaaagccacttctgaagatagcctgggcctccttttagaaactcctatattatggcaattgtgatgtaatgagttagataaatgaatttcaaggcccaagagactgcacctgtgtgtagccctttcctggtgatgagccccactctgcttgtgtgagtgcgtggagtcagggttacccacagtcccacagaggttctgtattcagccactgccatgcagccacgctggacaggcaccaacgaaagaactcctgttcacagggcctaaggaaagtgtcctggtccccatcgctacttttctgcctggtcttcagactgagtgcagttgaagtcaacaactggttctcaagctttttcgtgtcagaccctttccactctcaacaatgactgaggacctcagagagctttcatttacgtgaattctacctgccaatatttacagcatttgaaattaaaactgagaggatttggctgggcatggtggctcatgcctgtaatcccagcacactggcaggccgaggcaggtggatcacctgaggtcaggagttcaagaccatcctggccaacatggcaaaaccccatctctactaaaaatacaaaaaaaattagccaggcatgagggcaggcgcctgtagtcccagctactcaggagactgaggcaggagaattgcttgaacctgggaggcagaggttgcagtgagccaagatcacaccactgcactccagcctcggtgacagagtgagaccccatctcaaacaaaacaaaacaaaaccctgaagatttgaaatatatgtttattaattcatttaaaatgagcaataataaatgacatgttaacataaataacatttttgcgacaaatactactttccaaacaacaataaaattgtgagaagagcagcattgttctgcagttgtctttaatgtctggcttgatggaagacagctggattctcatatctgctttgtgtttgattgtcagtgtcacacttcatatagcctcccagagattgatcataaaaaaggcattgtcacatcttagtattatgaaaattgtgaccttgcagacctgctaaagggtttgggggacctcttagggttccctggaccacactgagaactgctgactcaagccaacagtggttgagccagcagttctttaactgaacagtccattctaattcattagcatcagacaccttcatggacacccaaatttcaaggtgtcttggcatcaggatccttagcaatttcccatctgtggatagaaacagttctcacttgcatgcttctatggtagtgcttcctgaagtacgtcttgaggactcggacgacgtatccaggatccacaggaagagtcctgtggacaagcagtggtgtctgctctggttttgtttgggtcaggactagagtgggtggggcagcatgagtcatccacggtggccgtttcctccctggccattgcctctctctgctcaagctctcaaactcatcttttatgcggctcttggtttactgacgctgcacttcctctcagtccgtgctactcctgagcctcttgctgagacagggtattcctttgctgagagggtgacatcttcacagaataaccaggaaaagtgaacaggtttctaatgtttttgtctgtgtccccctccagtgcccccacccggctttttgcccctgcttcaacctcagtgaactcaacggaagggtagcagcaccccagtgtgacattccaggcacaccctggccatggtcatcacatctgttggcagtgcctgctctggaggcctccccggctctccttccagcccagggcgtctgatgctctggcctgcgctcttgcccacgctaagaactagcatattccttgcacatctagcttctctttggctagaagcagggcttgcagcctcaggatttttatctagtaggattttcctgaaaaagcaaggatatttgctcactctgttacatgctttttcatatcccacctcacacctgtacacaccgatgtgcacacgcacatacccgttatacatgctctccacacgaaaattttcttctagccctgtggacattgcgtaaatttttacttgtagcaacatgacagacttatggctttctaaaatctacaaaattctagccagctacctctacactcatgcatgcacgcacacacacgtgcacacaagcgcacatgcactgtatcactctgtcattcccaataggataggatagagtgaatttgttggcagggcatgcattcagagtgctctacagtcagccctgggcccctcccactgagcccactccactgtgccctgtattatactttcctgagctagacctcacttccctatcccccactgtgctcatgctcccctgtgctggttaataggctgcccatcctgcagggaccagctcctgagcccctttatataagaaatgcttctctgggcatggatgagctcttccctatctgcacacttacagtctgagcattttgctgcctcacttctctggagagttcacatgtataagttggctccctgtgtcacccattaggacatcacaggttctttttttttttttgagaccgagtcttgctctgtcgcccaggctggagtgcagtggcgcgatctcggctcactgcaacctccgactcctgggttcacgccattctcctgcctcagcctcccgagtagctgggtctacaggcgcccgcaccacacccggctaatttttttgtatttttagtagagacagggtttcaccatgttagccaggatggtcttgatctcttgacctcgtgatccacctgcctcggcctcccaaattgctgggattacaggtgtgagccaccgtgcccggcccgcatcataggttctcgttttggttggctggttaacttgccaccactccccaagctggatattacttattttgtttggttaaatgtgtaggtactgatactgccatctaaaacacacctgctatgagaaacttttctccatgataagacttaggtctcactacttttgtttttctttgctccagcgcttgaccacatcccatcctggagagcagagggagaccgttctgcaagcctacatcagcaatgacctcttggactgttatagccacaaccaggttggtaagaggtggggccagatcccagccagggccttcaattctagggaatgatcttagcagatgggggaagcttataatttctctgcacattttcagcttcgtaactgtatgtcagccttgagctcatgaggttctgggcattggcttactttttgcttctagtgaagagttctaaacaagttagaactgcctgattcatcatctctggagctcttttctgccgtttttccttttctcaaattccctactctttacctcacctcactgcttaccatgagtcctgaaaactgagtatgacttcagagggacaaggtaggtaagcaaattcaggttgtttacatctgggcctgactaaaaatttctttaacacagtactttacttatagttttgggccagataggtctactgatcctgtgggaaaagtatgagacttggggtaaaataaactggctttcaaacctctgctctaccactcattagccaggtcaccgtaagcaagttactcagtctcaggcacctcctcatctgggcaaggagccgcgcctgcctcgggaggtcgttgggatgattacatacagtcaggtgggggaagtccttaagccccaggcctggtaccaagtagtcactacatggtctttctcttctgtccttgcccctcctacctgtatctgcaccaaacttcactggacaggaggaggatcaggattttgaatttggcacgtgttaagagtgtactacattttattatttcagttgaatttttatccagagtgctgtaaaaatgtaaagctattgttaaacttcacaacgtgtgcactgagtggagtatcaaatgctctggacactcaccgattaaacagctgtcttaggccatttcctgctgctgtaacagaataccacagatagggtaatttataaacaatccaagggtattgtgctcatagttctggagtctaggaagtccaagagcatggcgccagcatctggcaagagtcatcccaaagcaaaaggcagaaggcagaagtgagcgtgcaagtcagagaatgggggtcgaagctgtctttttatcaggagcctactcgcacaataactaacccactccggcaataatggcattaatccattaatgcctaatatcctcttaaaggtcccacctccctgtactactacattggcaattaaatgtcgatatgagttttggtggggacattgaaaccatagcaacagaccgtgggaaagtgagttacacattcatctgttgtgcatacaggcaatacaatctgagttttgagttgccagtttactctgtgaatgtagtcttaatgttctcatgaatgagttaagtttgaaaatagtctctcatattcttgacttattttcttgcttttttttcctgtttggatttataatggcattgaatccagcctacaaggcatgaagcagctgaataatgtattgttataacttccaaactcaaattaaagagtaaagtcaatactgattatttctaacattatttcattgagtcgaagatacactttttccccccattttaacatctttgctattagggtgtatctgacagtcaatggcattttacagtttaattggcaggggtttttttctttcttgattatgtataaaatgaaaatgtgtcctctgatgaaaggtgtgttgggttttgtcatctgtgatttttgtcaaaaaggcagtgacctctatagccattgaagagagtaatttcttcctcaagtcattatatgtagttgctatggtttacttatatatattttttgagatggagtctctcttgtcgcccaggttggagtgcagtggtgcaatctcagctcactgcaacctctacctcctgggttcaagcaattctcctgcctcagcctcccaagtagctgggattacaggcgcccgccaccacacccagctaatttttttatttttagtagagacgggatttcactgtgttggccaggctagtctcgaactcctgacctcaaatgatccacctacctcagcctcccaaagtgctgggattacaggcgtgagccactgtgcccagctgtggtttatttatttatttattcatttatttattttgagatggggtttcactctagtcgcccaggctggagtgcagtggcacgatctcggctcactgcgacctccacctcctgggttcgagcgattctcttgcttcagcctcccaagtagctgggattacaggcatgcgccatcacgcccagctaattttgtatttttagtagagatgggatttctccatgttggtcaggctggtctcgaactcctgacctcgggtgatccgcccgcctcagcctcccgaagtgctgggattacaggcctgagccactgtgcccagcctggtttatttttttaagaagaaatgagctgctgggcacagtggctcatgcctataattgcagcactttggtaggccgaggcgggtggatcaggaggttaggagatcaagaccagcctggccaacatggtgaaaccctgtctctgctaaaaaattagccagacgtggtggcacgcacctgtaatcccagctacccaggaggctgaggcaggagaatcgcttgaacccgggagacggaggttgcagtgagcagagatggcaccactgcattctagcctggcgacagagtgagactgcgtctcaaaaaaaaaaaagaagaagaaatgagctgaacgcttgaacccttttacactgctggtggcaatgtaaattagtacaaccactatggaaaacagtacggagattccttaaagaactcaatgtagaactaccatttggtccaacagtcccactagtggccatccacccaaaggaaaagaagtcattatatgaaaaagacacatgcacacacacgttttcagtttgcagttacaaagatttggaaccaacctaagtgcccatcaaccaaagagtggataaagaaaatgtaatatatatacaacatgagataccactcagccataaaaaggaatgaaataatgtcttttgctgcaatttggatggagctggaggccttattctaagtggggtaactcaggaatggaaaatcaaatatcatatgttctcacttgtaagtaggagctaagatatgaggatgcaaacaaaaattttataatggaccttgcacaggtgacagtgttcactgtatccactgggtgcactgaagtctcagaagtcaccactaaataacttatccctgtaattaagaaccacctataacccagaaacttgaaataaaactttttttctaaaaaaaaaaaagaagaaataggccaggtgtggtggttcatgcctgtaatcccagcactttgggaggcctgaggtgggcagatcacttgaggtcaggtgtttgagaccagcctggccaacatggtgaaaccctgtctctactaaagatgcaaaaattagccatgtatggtggtgtgcacctgtaatcccagctacttgggaagctgagtgcttgaacccgggagactggggttgcagtaagctgagattgcgccactggactctagcctgggcagcagactgagacgccatctaaaaaaaaaaaaaaaaagaagaaatgagttgaagttctcttaagatgtcagagaatctgcagggcagaaagactccttgtccaacatggatgctgtgtcactatggcaccaaggtaaactgacctgtacagacaggaaattgaattcgttggttcattcctctcccatagtggttctcaaagtttaacatgcatcgttatctcctggaggtctcattaaaacagatcactgggtcccaccaacagtttccattcaataggtctatggtggggcccaaggatttgcatttccaacaagttttccagtgatgctaatactgctggtccaggatgcgttgagaattacagcttgagaccaaaaacttgaatggagccaaatttaatgaaattgtagagaactgaatttttcatttttagctgaattcttagtttctagacttcataaatatctctcttcatatctctaagcatcttacccatttttaggtgtacagttcagtggtattaaacacattcataatgtgcaaccatcatgtgccatccatctccataaataacttttttcatctagtaaaactgaaactctgtacccattaagcaataattctccatttccccctactccaggcccctggcaaattcccattctactatctgtctctatgattgtgactactccaaatacctcatataagtagaattgtacagtatttttctttttgtgactggcttatttcacttagctaatgtcctcaggttcatccacgtagcatatgtcagaatttctttcctttttaaggctaacatttcatcatatgggtggaccatattttgcgtatctatctcttcctccgtcagtagaagctactgtggatagtgctgctgtgaagtgtgcatgcacatcctgactgttgtgttaatccgctccttgcttttctttatagttttcccatctatgtatatcccgcataatacagtgtttgcttttgtgctgagtagcaagcatcagccttgctctgcaaggaaacaggactgtgcccatgttagatgaagttagctaggagaagatggcataaaccaaagtttgggatgacagttagacatagcctccctgagcacttattgatcccctctggggacattggtaatcaaaagtgggagagagtcctgggaaacacagagcgtctggcggaattgaaaggtgggccaggtaccagttgtccaacagcaatatttattttttttttaattttttgagacagtctcgctctgtcacccaggctggggtgcagtggcgtgatctcggctcacttcaacctccgtctcctgggttcaagcagttctcccgcctcagcctcctgagtggctgggactacaggtgcgcgtcaccatgcccagctaattgttgtatttttattggagatggggtttcgccatgttggccaggctggtctcaaactcctgacctcaggtaatccgcctgcctcagcctcccaaagtgctgggattacaggtgtgaaccactgcacccggcccggcagcaatatttatgcctaagggcaatggtgagctgctgtgtattttggctttacgctcacttgatctacttctagttctcaggggttgatcacttgagaacacttctgtgggagtaaaaaactgttcgcagctaatccacacagcagggcatggaagggggagctagaacttcactagcactgtttagggttatccaaatgcagataagagtctgggctcgtttcaccagtcattttgtgctctgtttaaaaattgggacctcgtgcactactttggaacacgggcagcgtttactaaaactgaataccttatgtcctagcaaaaccactcctagataagccccaaccaaaacgtgcccatatgttcactaaaaaacatgcaagaatattcatagctgcagttctagaaccaaaacactggctgcaacccaaatgtccatcagcagtagaatgaatacctgtgatgtatttgtaaaatgggataccttgagcaatgagaaggaacacagcagagaccctgggtgaatatcacagacatattgttgaatgaaaaagtcaaacataagagaatatataatatatggtttcatttattaaaaaatttaaggaggagccaagtaacatgaatctatgatgttagaagccaggagagaagtcacccttggtttggaatggggttctggaagggcatctgggactatggtcatgttctgtttctttatctggttactagttagccacatgttcgctttgtgaacactcatcaggctgtacatgtgatctgtgcaatgccctgtgtagatgctatacttcagcaaaaaatcaacctaaatgggtgtaatggtaataggcatcttggggacgacagcctttgacatgttgccctcttgaattagctgggtttagtctggaaaacattctggtgcatagctgctgtccaggagtctcttcaccaaacttttattgattcctttcacctctctcctgaattggatctctgtttccagtgtcccatattatcttatttcttgacttgttctctcggttggtggaacacatcctttagttaataacgtctagagaaaaagtacacaggaagtaaatttttttgagatcatgtatggtcaagaaatgtcttcattcttcgtatagaatcctggattgtaaataattttccttcagaattttgaagacattgctccattgtcttttaggttccagttttgctgtacagaaatccaaagccagctgggcacagtggctcatgcccataattctagcactttgggaggccaaggcaggaggatcgcttgagcccaggagtttgtgagcagcctgagcaacatagaccccattctctaagaaaaaaaaaaattcttttaaattaaccaggcatgttggcgtgcacctgtagtcccagctaactcagaaggctgaggcgagaggattgcttgagcccaagaggttgaggctgtgagctgtgatcacaccactgcacttcatcctgggcaacaaagtgagagcttgactcaaaaaatttaaaaaaagaaatccaaagccattccaattctttatcttttgtatgtgacctgtgtttctctccctagaagcatattgaatcttcccaatttcccattgacgtccttcatgaggtatattttaatcccttttattgagcactttgtgggccctttcagtctgacaactttcattctggtcttgagttattttgttgatggtttcttccctctgttttctgtgttctctctctgaatgttgaacctcctgaactggttttctattatagttttctctcatcttttctactttttgttccactctttaggagatttcttttcttcttctttttttttttttttttttttgagacagtctcactctgctgccctggcatgatctcagctcactgcagcctctgcctcctgggttcaagcaatcctcctgcctcagcctcccgagtagctgggattacaggtgtgtgccaccacgcctggctaatttttgtatttttgtagagacggggtttcaccatgttggccaggctggtctcaaacccctgacctctctgcccaccttggcctcccaaagtcctgggattataggcatgagccaccctgcccagcctccctagcagatgtcttcatctttattttctgacccttctgttgacacttttatttcctttttgatagcattctcttgtttcatggatataatacagtttcttatatctttgaggatattattgatgaatttttatttaatttttagttttcttctccctgcacggtctcatttactccaagccccgcccccaccctccccccctatttgttttggcctcctggtagaaacttttctcagatgtctgctagtccttggtgatctcctaatgagagatttggagtgaaggggaccacaaagccattgagtgtgatggtggggcctgtcgatggatagttccacccagggggatctgggtgggccgtttgctgggaacctctgatttcacggtctctaattctttccccgtgggctggtcatttcactgtgagaatagtcttctaatctcaggcctagagggcaaaggtctggttgccagggtcctgggagccaagttttggggtggccctctgttccacattcattctgcatttagacactaacccccctctccattttgttctagaaccccggcaagccttgctctcctctgcctggtgtcccagatccacagaccctttgtgtctccctcacaagggaacaccctctccccagccctgtgctgagaggtgtgcaggagtcacatgagtgggatccaagtgcttcttgaacaactttaattcattcgtctttatttttcttcagctcttaagtgctttgaggagtgagtaatggaaattgggtaattccacagtgcccgttgctgccttgagatttggccttcttgagcctgctaagcctcttgccatgctgcagtcccacttccagaattgtggcgttatcgtttctcgtgctgttctctctgtccttgggaattatcttttttaacagtccatttattgtagttttactgtggcttagagggagccaaattagtcatgtgtcttggatctgccattctaacctggaaaacagccgcaacggtaacagcaaacaggactgcttccctcgcgccagtcactgttctgagggcttcgtgtaattaattcatttaatttggaagtctgactaacttatttttgccaagtctcatcaaatttcagttggaaaacaaggattccagatgaaatgtttggctttagtctgtttatttcacctctaataaattcaggcagaggaagagaactaccagacccgaagaggaggcgtgtgtttatctctccgtgttcttaaccttgtttttcctcttgacgttttcccccagaggagtgtgcttcagttgctgcactccacgagcgacgtggtgcggcagtacatggccaggctcatcaatgcttttgcgtcactggcagaaggtgagacatcagctttgcttcaaagataagagctaggtcatattgatgtgctttttcctttgaaaatgagcgttcctcccaagtttcttagagatgacgcttcctcagtttgttaccgtttaattcatctaaggtcttttgtgaaaattaattgttgtcatattgctttagtttatatcagagcacatttggacagtttttggggtttattttgtaaacctcccggttttattttataaagctttctggttttgtaacatagtaacattttatattgctttcaagtatatcacaggtaatgaatgcatcttctataattttctacttaaggcaaaataagtgaaacaattacggcaaaataagcttagcgaaacaaagcagactccaataaacactgcaccatttccttcagaagactatgacctcttaaatcaaaggatttgaaaactctgaaaataacatgcccccataactgaatttaaaatgattttgcaaagtgccattatcttccgtaagttcttatttatttgagctctttataatgtgaataaagggagttttcaaattatgaatatatgatactccaaaactttgttcatttgttcattcgttcttccatccatttggcagacatttatgataagccaggatgtgttactgaggaccattcatataataatactgttgaaacttatgtctgaaattaacatcttccatatccattcagaagtccacaacaggctagggaccattctgggcttattacagggtcccaggtgtggcttcctgcttcttctccaggccttgtacagagagtgtgtatggaagcattccttggctgcctctgttgtgaagacttaagggctcataacacacacattacccctcatttctctttgtagatctgactgttgggttcaggatttcatggaaaaaaaaggacaatgctccccacaagaacacagcaatgaattatgtttagctcacaagaagagtggtttttctagtcaccagatatttcattgaataaaaccaacgtttaacgtttagaagaaatatcttttaataagttttaataagttttgtgggggttttgtgtgtgtgtgtgtgtttggtttttttttttttttttttttttgagagagtctcactttgtcaaccagactggagtacagtggcatgatctcggctcactgtagcctcaaccacctgggctcaaggaatactcctcgcgcctcagccccccaattagcgggatcaacaggtgtgcatcatcatacctggctaatgttccttagtttttatagagatgaggttacgccctgttgcccaggctggtctccaacgcctcggctcaaacagtctacctgcctcagcctcccaaagtgctagggttacaggcgtgagccaccttgcacaaccagtaagtgtttgtttgtttgtttgtttgtttgtttgttttgagatggagtctcgctccgtcattcaggctagagtgtggtggcacgatctcaggctcactgcaacctgcctcctggggtctagcaattctcctgcctcagcctcccgagtagctgggattacaggcatctgccaccacacccagctaatttttgtatttttaatagagacggggtttcaccatgttggccaggctggtctcaaactcctggcctcaggtgatctgcctgccttggcttcccaaactgctaggattacaggcgtgagccaccgcgccctgcccagtaagttttttagaacataaaattacccaaactctactgtgttatatgcaaagtaagttttcgtggaaagtggttttgtagcataccagataaattatttctgtctttcacctgtttcatctctggtgtattatcaggtcgcctctaccttgcccagaacacaaaggtgctgcagatgctggagggaaggctgaaggaggaggacaaggatatcatcaccagggagaatgttcttggggccctgcagaagttcagtctcaggtaacgactgtgcaataggtcacggtgtctcctgtgagatcagattgagttaaaattcccatggcaacccaggaggcagatggtatttttccactacactttggagaggttggatgactttctaagacagagctagaaagcttatctgtaatccactaaactatcctgcgcaaggctgctggggatggaggaagacattttcaaagcatcattggattttcctaatggacattatcgagtgccagccatgcaggattgtgtctcagggcatgtgcagggcttagagacagacacatgaatcagacctgatagagcctcagccctcaagttacttccagtcccctgtgggagctgcacacatgaatgcacatcccagcagagtgtcaagggcagttctgtggaagtcagggttagggcctcctgaccttgtccatgatcccagcagcccaccccatgggatcagcctagaccgtcatgacttggaaccaatggggccaggctaatttctgtatttctagtagagacaggattttaccatgttggccagtctggtctcgaactcctgacctcaggtgatccgcccacctcagccccccaaagtgctggaattacaggcgtgagtcaccgcacccggccccgtaggttcctttttagtttacagttttgttgagatgtatttacacaccataatattcccccatattaagcatacaattgaaggatttttagtgtatttacagagttgtgcagtcatcaccacaatccaggtttagcacatttccatcaccacaaaaagaaacctcatacccatttacagtcactcctcattcctacccccagtccccggtagccacaaatctgctttctgtcgattgacttgtactggacgtttcatataaatggaatcatgtagtgtgcactcttttgtgactggcttctctcacttagcatcgcgtttgcaaggtttgtccatgtagcagcatgtgtcagggcctcattccttttgtggctgaatatgtactccattatggctacatcatattgtttgtttgtttttgagatggagtctcactctgtcacccagactggagtgcagtggcgcaatcttggctcactgcaacctccgcctcccgggttcaaccaattctcctgcctcaaactcctgggtagctgggattacaggcgcacaccaccacacccggctaatttttgtatttttagtagagatggggtttcaccatgctggtgagtctggtctcgaactcctaaccttgtgatccacccgcctcggcctcccaaagtgctgggattacaggtgtgagccaccgcgcccggcctacaccacattttgtttgtccttcagttgattggcatttgagttgtttgcatttttggccaatatgcataatgctgccatgaatgcttcagcacaagtcttcgtgtggacatatgtttctttttctcgtggatcggcatctaggagaggaactgttgggacatatggtaattttttcagagtttttattctctcatgatcacctcaagttctctttgactttcttgagaactctagtccctggagtcttcaacttttttctgtcggtcctcttctgaacacactttcttcccatcaaatgtggtttacatttgactgactcacaaataaccagaagcctacaaagtgaaatggtctaagcatgtgtgtttttagtgggggaagggataggtatttgtatctaccatttgccagctccctgccaatgaaaattctttgttctaactatatgaatcgaaaagaactgtaagtgctgcagagtcattacttcctcagagcatacaaacacttcatttctttttgtttatagagagaactttgctccatgttgatcgctttggggaagtttttagaaattcaataactatagttaagtaacagatacaagatatggtgaaaaaaatacttcctcctggtaatgcaaatgtttactgcctgtttatcttttcctctaagtgttaatttaagcttttttgttctgtaaatgtgcttaacctttttgcagttttccagagtctctgcaataaatgaagaaggtagctagttaccaagagagcgcagtcttcactgtattctaataagccaccctgattgggtcagtgtagtgtttaagaacaggatgaacggataactggttctgctgttctgtcctgagtggtggtttcaccataacctgcgcatccggagatgtgcagagctggcttctctgtggcatgtcagttttctactaatccagatggcatctcataatgataccacacttagtctcagcaattcttaaagctaacctgatgacattcaccatcacacattttgatggggtattggattttgtaagattctacacctggactttgggtggaaaatcattccttataatttgcattaaccaggtcattaaactacccttactctatagaaatgtgaatcaaagtgatgttaagctaggcttttgctcctccttgttttctttatttttatacagctcagagtgcctagagctggattatagagcgtttaggtaaaaatctatttgtcagctgggcacggtggctcacgcctgtaatcccagcactttggaaggttgaggcaggcagatcagctgaggttgggagttcgagaccagcctggccaacatgaagaaaccctagctctactaaaaatacaaaattagctgggtgtggtggcgcatgcctgtaatcccagctacttgggaggctgaggcaagagaatcacttgaacccaggaggcggaggttgcggtgagccgagatcgtgccattgcactccagcctgggcaataagagcaaaactccgtctcaggaaaaaaaaacaaaaaacctatttgtcaaagaagtatttctatggtcctgtttcctgggttaagtaaaccaaaagctacaaataaatatttattagatatttgaagcaatgctctgctaattttaaatattgaaaaggaaactttcaaagtaggaggcctccttaccaccttatctttatttaaacccttaataaatatccctgaaatgtaaagaatttttgttatttcaattgtatgggtttaacaaaaatattcctcagagtctatgtcttctgtaagtttgtcttttctgatatgcattcacattactgtttcttcttttttttttttttgagacagagtcttgctccatcgcccaggctggagtgcagtggtacgatctcggctcactgcaacctctgcctcccgggttcaagcaattctcgtgcctcagcctcccaagtagctgggattacaggcgccgtcaccacgcctggctaatttttgtatttttagtagagacggggtttcaccatgttggccaggcttgtctccaactcctgacctcaggtgatccgtccgccttggcctcccaaagtgctgggattacaggcatgagccactgcttccagcctactgtttcctcttatatgaaaagtttcttggcagtttgtatttaccgtaggctctttcttcccaggcgcccgctgcagacagcgatgattcaagacggcctcatcttctggctggttgatgttctgaaggaccctgactgcctgtctgactacacgctggagtactcggtggctttgctcatgaacctctgcctccgcagcacaggtctcagccccgaccctcattctagtgcaagaaggggaagagatcttgactcttgaagctgggtttctagtgagcctgatatggtttgcttttagtctcatagaaaactaaaaacagaaaaaggagtagaaagcatttccaactaggtatcaagctgttgaatccctgaaggcaaaatccattcttgccctggaaaaaatgtcttgtatatatgtagtgcctgcattaagaggagactaagttcatttacctttttctttattgcattattcagaggtaggaaattaagaatatgatccccttttctgaagacaaagaagtgtgttcccaagatactataggattaagctggccgcagtagcagtgacactaaaccacacttcctgccctgaatcacactcttttccctgccccagccctggaggtggaggttctcctgtgggcacaagtcatttatatacttgatcagtcatttatatacttgatcgctgaaggtagtgatttgagcttttccaggtacaggtactatctcatttaaattgttacctgggatgaaagaagcttctttagaagaggtgccacctccaggctgtggctttccccagcctgagcatccagtgttaggagagaaaggctccctgggtaaacagctggctcaggaggacttgttggagcatcttcccctctatatactttgtagactgaaccatgtaactgtgtgttgttgactgagtaaatgactgttatttcagtcatttaaaaaaatagcatgcaaaaagtcctagccttttttttttttttttgagatgaagtcacgctccattgcccaggctagaggcagtggcatgatcttggctcagtggtgcaacctctgcctcccgggttcaagcgattctcctgcctcagcctcccgagtagctgggattacaggtgcccaccaccacacctggcgaatttttgtatttttagtagggagggggttttaccatgttggcaaggctgatcttgaactcctaacttcaagtgatccacccacttcgccctcccaaagtgctgggattacaggcgtaaagcaccgcacccagccaaaagtcctaacttctaatatgtttatcagattagaattagcttttcttcatcatcatcaccatatttgcagtgatttttatgatgatgtttataactactaaaatgcctatatggtcttcctgatggtggtgtccgtgcgtgggagggagaacgttgctctataatgtattgtgctttcactgtaatgactcgctctgtgctctgaccggagtaatagccaccacttgggatggtttactgagcaccgaggttctatgctacactgagtcctttacatacattagtctacttaattttgcatcaccttttgaggtaggtatgaatagtaatccctgtagtaaagaagaggaaactgaggcccagattggttacatgactcacccgaggtcatacagctcacccgaggtcatacagctcatgagcagaggagccaagatttgtctccaagtctacctgacctaaaattgtgcttctgggtttagacatgtcatgtttagctttgatttgtttcccatagggaagaacatgtgtgccaaggtggcaggcctcgtgctcaaagtcctttcggatcttcttggccatgaaaaccatgaggtactcattcagcactgctggccctgggctcggggaggctacactggggacccaatgcctgtgaccccacaggcacacagctggcccaggatggttgctgtatttgaaaactgtacatgttctctgtccttctgggattttcataagcaactggaaatcttttataatttttagaattttggaagtcagaagcaggatgttctttccgtccctgtctgcttggcccactggcctgtgccgggcccctccggcattgctgtttctcatcatctagcccccaacattcctcccccacatgccattcccttggtatgtttaatgtatctctgtggatgtggatggagccttaaaagagatatgatactgtgtatgtgtgtattgaatttacagaaatagattgccctttaagtctcattctgtttatggcttttcccttgtgtttttaggacctttctatgttgctttacatatgtctagttcattaagtgtcactactgcaaaatagccccttgtttgtgcccctgacattttacttatccagcctgtacacttcgagtgccatccactctctgttgccacagcagtcctcagtgggcatggctgcacctgccccatgggagcctgtgccagagcttccagggatgtgtagacactcatcactactggctgccagcatacatcagtttcaggtcactgagtcctgccaaattgtcctccagaatggctatactagcgtttgctctcaccagtgttgccccaacacctggtgttattttctaagtttttaacctatgggccccaagcactttttaaataaagtagaggtatgtatgggtaaacaaattaacaaaaacaaataatcaaatatgattattctctcacttgccttctacaagtgccattgcagaaaccacggcaaagcttcaacaaaaatctaaccactttagacagatgagacccaggggtatatctgagcaggatacgattgagtaccacttggtttccacacatctgttcccatttctttctttcttttcttttttttcttttttctttttttttttttttttgagacagagtctcactctatcatccaggctggagtgcagtggtgtgatcttggctcactgcaacctccacctcccgggttcaagcgattctcctgcctcagcctcccaagtagctgggattacaggtgcccgccactacgtctggctaattttttgtatttttagtagagacggtgtttcaccatgttggccaggctggtcttgaactcctgaccttgtgattcacccacctcggcctcccaaaatgctgggattacaagcctgagccaccatgcctggcccgtctgttcccatttcaagcagacagctcccattctggtcattccattcacattttacaccagccctatccactgattggtgtgacttctttagcaagtggatgtttggtgtctttgtgacattcattttatattttaaagctagtgagctctgaactacttccaggcctgaatgaactctgttcctcactttattcaactcaggcaggtgaaaccagtgggaaacatattcttccatctcataataaaggttggtttcaagtactggaaccaatatgtctgctctgaaaacttaatagaccaaaggattcatcatatcattacctgctaccaatgcattggctttgaaaatgagctggatgggccgggcacggtggcttacgcctgtaatcccagcaattttgggagaccgaggcaggaggatcacttgaagtcaggagttcgagaccagcctggccaacatggtgaaaccccttctctcccactgaaaatacaaaaattagccaggcatggtggcttgtgcctgtaatcctagctactcaggaggctgaggcatgagaatcacttgaacctgggaggtggaggttgtagtgagctgagattgtgccgttgcactccagcatgggtgacagagcgagactctgtctcaaaaaaataaataaataaagtaagaaaaagaaaatgagcttgaaaaatgacatatatatatacatatatacatacatacatacatatatactttagagccaagtaatatgtttgctacactgtagtagtcatgatcttgaaagacaaaaccaaaataaagaaaaagatgcacataactgactatatgaacattacattttttgattggaaaaagatgccataatcaaagtcaaaagatgaatgaaaccccgaggaaaagttgcatcacatgtgacaaaagtttaatattcctaatagatgaagagctggtataaattggtaagtaaaagtcaagcaatccaatcgaaaagaaggataaaggatatgactagacagttcacagaatcgtgctgccccagaaacatgaaaagatgttcagtcgtgctagttcaatcgggaactgaaaataaaaacaaccgtaggatgcctttttttacccatcagcttggcaagcattgaaagtgctaatgaagtccagtgccgaaggagggcggtgggaaacgagccctcctccattgctgtggcaggcacagcgtacagcctgctgaaaagggaacttgcttatcagcacctgccatgctccatgtcccatgtgtgcaagtaaaacatgggtcctgtcttcaaaaagctcataataaaggggacatagtgtgaatttaaaaggatactgcctccagtgctgtagtggagggatgtacaagaagcggaagtgagtggcctgtatgggggcagtggggcgggggtgggttcaggagagccttcccaggagacatgtctgggcttagttttcaaggttcattgtatgtgtgaagaccattcctggcaaggtgaactgccagaacctggctgagacatggaacagcctggtggggggcatcccttaggtagtatggacactttgtggtggcagggaggaagaagcagaggtcatgagatagaggccaccccttgaagatcctgtgtgccacaccaaggagttccacctttccaactgggctctatggaaggtttcggagatggagagagggatgatttggcccacgctatagaatgttggtagtgatcgatggttacattaaagggtgaatattgagggtagagagactggtttggagatttgatgtagcctggttcatggacgatgatgtctgaacaaggacagtagcagtggatatggaaaaagaggggttcctatcgaagaggcttgaagacagtattggagactgaacaacaacaacaacaaaatcaacgatgactccagagtttctagcctgagtgattaggaagttaaaggtaactttaattaagcaatgaaatgcgcaggagtaagctttgggagggagtgacgaatttggttttagactcagtggtagctgtcacctgggcatgcagatggagatgtctgtcacttggaaacatacatcctggagcacaggagagctgcgaggacgggaacacccactctccccatttgccagattgttctgaggtgtggtgtttgatatagagttgtgcagtatttgaaaacttgcaaataactggtttttttcctccccttaaagatacagccgtatgtgaatggagctctgtacagcatcctttctgttccatccattcgtgaggaagcaagagcaatggtaagaaagcgtgcctgagaaacatgtgagcttcctttagtgccacagttcagagcttttagagcaagacctccttgattgggctccatagaaaggctcagatccgttccaaactccttgaaattgtatgtaaaatgtatatttgccatttcctggggagagagtctgtagcttttatcagatcctcaaggggatccctaactcctaaatggttaaaaattaaagtgttagaaagttcccagcaggctgacttttgcaaagttatagacattctgatggcaaccaaatggaaaagattataaaactgtctaggacttggtttggttggtaaatagtaaactcagtgtttaatgtgtacgttaacgcttgtatgtgaagtaaaaagcaaacctcaggtgattagtatattattttgaaaggacaagtgtttctagatctaatcaggaaaacaactagagttttgtcttttttctttctaccatgtgaaaccagattaacagtgtattaaatgctgtggtgaaaggattaaatatatttccaccttcaaaacacaggcaaaattctcattgagaccaacaaaacattcttctaattggttttgcttacttaaagaattgctaaatcttctcattgatcatttaaaattacatcaacagttacaccagagaccaaacttatttaagaaccattctatgtgatcacactaaacagtggaccttaattgcctactgcttttaaatttcactacagaacaggggaaaataaacttgcttaaattctgcgttatggtcatttaggtgaaagaaaggggttgtcaaccaaggcaaagaagaggaaaaaacatgtaggctgaagagaaagaatggaggtaacattcagtcaaagtgtgagatgcagcatggaggaaaggcaccagggcaaagggatggagggggtggggagtgaagctgaggatggggccatgtgaggaagagtcacagttgcaggttgtgagagcaggactgcccttagagatcccagagcagggagaaaaaagacggaagagagggacaacttccgaaacctatgtgacaacatcaggtctgacagatacccaataggagttccagaaggagacgaatgtgagcaaatggggcggaaaaatgattgaataaataatgaagacatggtgaaaaatacaaacgtaacagtaaggtgtctaggaaacccctaaatgtttggaaaataaacagcacactggtattagttatctattactgcataacaatttaccccaaagcttagtggcttaaacaagtttttgtttttgtttttgagacagagtctggctctgtcacccagactggagtacagtggcaccatcttgactcactgcaacctctgcctcctgggttcaggcgattctcctgtctcagcctcccaagtagctggaactacaggtgtgcaccaccacacctagctgatttttgtatttttagtagagatggggtttcaccatcttggccaggctggtctcaagctcctaacctcaagtgatccacctgcctcagcctcccaaagcgccgagattacagatgtgagccaccatgcccagccaatttttgttttagtttttgagacagggtcttgctcttttgcccaggctggagtgcagtggcctgatagtagtgcacactgcagcctccatctcctaggctcaagccatcctcctgcctcagcttatccagtagctgggactataggtgtgcgccatcacacctagctaattttttttaagagacagggtcttaccatgttgcccaagctggtctcaaactactaggctcacgtgatcctcccatcttggcctccatgcagggattacatgcatgagccgctgagcctggccattgaatttttaaattacagtcatgtcccatgtaacaacattttggtcaacaaaagactgcatatgtgataatggtccaataagattataataccccatttttactgtaccttacctatgtttagagatgcttagatacacaaataccaccttgttacagttgcctacagtattcaacacagtcacgtgctgaacaggtttgtacactaggatcttattagctatgccatatagcctaggtgtgtagtaggctacaccatctaggtttgtcacttactctatgatatttatacaataatgacatcatctcacaacacatttctcagaacatatccctatcactaagctaccaatgactgtttctgtgggacaaacattcaagagcaatagcagcgtagtcctaactaagagttgctcagtttatagttgagacttcagcctctgcttccaagctcactcacctggctgtcagcaggaggcctcagttttcttctggctattgactggggacctcattttcttcccccttgggcctctccataaggcttctcttgacatggcagttggcttcccctagaatgaatgatttgagagagaaagtaagcaagacagaagccccagtgtcttttagaaaaacctactctcagaaatgagataccatcgcatttattgtcttggttacacagacccaccctggtacagtgtggaggggatggaaccaaggatgtgactaccaggaggtggaatcactggggccaccttggggctggctgccacacactcctaagtaactgtgggtcaaagaaaaaagcacaagagaagtgaggggctattcttttgaaaaatattacaaatattttctcaattttggtttgtctttttaaattatggtagttagccagaagcggtggctcacgcctgtaatctcagcactgttggaagccgatgtgggcagatcacgaggtcaggagtttgagaccagcctggccaacttggtgaaaccccgtctctactaaaaatacaaaaattagccgcgtgtggtggcacgtgcctgtaattccagctactcaggaggctgaggcaggaaaattacttgaacccaggaggcagaggttgcagtgagccaagatcatgccattgcactccagcctgggtaacagagcaagactctgtctcaaaaggaaaaaaaaaattatagcggtcttggtcaaacatcagctttaatgatagccagatctgttaatattttccttaatggcttctacataggtttctagataggctgtgagttttggactttgaaaaggaaatgtggattacttacataaagatgtaagtagatgatggggcacggtggctcatgcctgtaatcctagcactttgggaggctgaggtgggtggatcacctgaggtcaggagttcgagaccagcctggccaacatggagaaaccctgtctctactaaaaatacaataattagccaggtgtggtggtgggcgccgataatcccagctactcgggaggctgaggcaggagaatcgcttgaacccaggagacagaggttgtagtgagctgagatcatgccactggactccaccctgtgcaacagggtgagactccgtctcaaaaaaaaaaaagacgtaagtagaataagcttccctctggcatttaacagagattaaagatataagccagggaggaacccccttttagcctgagaacgcatcagctaggcagttgcctacttaattatttgtgagagtgacctctaagggatgatcatgcccacaataaggtttttctaaaaccctgagatttccctcctttcgtgtttatccttgaggaagtttttagattgataaagccattatattctctttgcatgtaggtctcacatgggtgcatttgcttggcagagtttaggttgtatgcctgcaccctagctgaaagggaggctagaaatgctgaataatgaaggaaataagacaacaaggaaaacgtttcccacaattcctccaccttgacatctgatcgtgcacggtgctagggaagtggaggcagaattgatgtcctcagccctgctggtatttggtttttatttgtttatttttttgagacagcgtcttgctctgtcgcccaggctggagtgcagtggtgggatctcggcttactgtaacctccgcctcccgagttcaagcaattctcctacctcagcctccagagtagctgggattacaggtgcccaccaccatgcccggctaatgtttgtatttttagtagagacggggtttcaccgtgttggccaggctggtctcaaacttctacctcaggtgatccacccacctcagcctcccaaagtgctgggattacaggcgtgagccaccgcgcccggtgcctgctggtatttgtatgtgtgtcagcacagtccttctggaaagcagtttggcagttacatgaaaaatcactaaaggatctatcttttggactcattcattttcttctggttgttgatgcacagaagaagagctctatgcatgacaatgctcatttcaacatttttatgagggaaaagctggaagcaacataaatatctagtaatacaggaattgctaatgaaattatgattcttttgctcaaaatattaatatctattgaagatgataattaggaaaagcagtacgaagcagtatggaaaaatttattttactgtataatgagagataaaagcacagtatctaagaatgtatgtgctcatggaaaatgacacaatatacataaaaattacattagtaccaaatgctattatagtaatcttacaagaatacctaaagggaaaaaggagaacaaaataaatgaatcccctgaggcccatttgaactttaagagcctgccaaggcctggggctggagaagagatcagataagtggagctgccctaatacccactccccaggcctcctgcgactagggctggagtcatagtcagccatgggcctctgccctggggaccccaacaaacatcctgcccagggctggagccgatcagaggctctgcaggttataaaagctcccagaatctgggaaggccagggagctgggcttagaagccactcagcccagaggaatgtccaagcacaccatggggctgctctgctccagtgaccctggggcccacagcacaggcccatgatgccagaaactgcctccgctctctccagagggctgggtgctgctgctccccacccaacagaatgatgtgtattccccacgcacctgatcctccacattgcccacttctgaatcaaagtcatttgcttggcagaatctaggtggtgtgcctgcaccctagctgcaagggaggcttggaatgtgagtattctgtctgttgccttgggaaattaacagtgtagagaacctggttataaggcattcatcagccacaggtgtcacagttgtccattacaggtggtcagcctagtcactgtattccgtgatgctcactaggtatgggctttgctttgctttgctttgctttgctctccttcctttcgacggggtctcactatgtcaccaggctggtctcgaactcctaggctcaagcgattctcctgcctcagcctcccaatctcatgattacatgtcatgtaatctcatgtcatgcaatcatgtcatgtaatcatgtcatgtaatcatgagattacagacatgagtcaccacgcctggcctaagtatgggcctttcaaaattagtgtagaaatttttcatattcttggccccataattctacttctgaagctccacacaagacatgagcaaagatgtatgtatcagaatgttcattccagctttattgatcatagcagaagacaggaaacaatgacaagacctaacatgagggagtgactaagaacagaggccggaaggtagagtagttgagagtgggtactcctgagcctgaggctggcttcgaatcgtgttccaccacttcctagttggctagtgacaactgaagctctcagtgtgatcgtttttccatctgtaagatgaggattattgcagtaccaaactcataggattgaaagcattgaaggagctcataatatatttagaagattgcctagcgtgcagtaagcattgagatgttagctgctattattattattatagctatgaaaatgtagtttataagatttttattgaacatgaaaatgatcataaagttaaataagaagcaacatattatcagtatattctgagttacgtaaaacaatgtacataaaaggaaggaaatacttcagaatgttcccaattatctctgggtggggggcctgtgagtaatttttattctttcttttatgttgtttgcaagttttctatacagaacttgtgtcactttcataactagaggaaaatatttatatctacctgaaatagatatttgaatttctcaggggaaaatttcccttgaagacctttagtgatagaggattagactgtgaagctggaacgatagaatgcgctagagagttcagttgttgagtaaaagtagaagtgagttcgaagttagttgttctgtgtagtgttcagtgcgtgttgtcaggctctggaagagatgctttctctcatttaatccctcaaaggtcccctgaaggagtgactgcggttgtgcccattttgctgctgacaacatcaaggctgaaaggtgaaatcctctgcccagggccacacggccggcgaggggctacgcaccgtggtttgactccagagccctctgcacctgtgctgcagtatcactccagacttgggactttcacctagtcagacatctgcacatgacaaattgttttctttaacactatatatacaaacacaggcttctctatgattatctttatggtagtctttaatgatagctagctggaaggagcaggagttccttatttactttttgcacactgcttgtattcccatttttatgcatctggattattcactaggaccttttattatccttctgtcttcctggacattgttacctgacctaaattatctgaaatgacaagttattactttcaggataagatgtggttgttctatgacttctttctataatttagatcaaatattacctaatatatgtgattttttaaaaatacatgatattttggctgggcacacaactcacacctgtaatcccaccactttgggaggctgaggtaggaagactacttgagcccaggagttcgagaccagcctgggtgacatggtgaaaccccatctctacaaaaaatacaaaaattagtcaggcatggtggcacatgcctgtagtcccagctacttgggaggctaaggtaggagagtcacttgagtcttggagttggaggttgcagtgatcagagatcgtgccactgcactccagcctgagtgatagagcaagactccatctcaaaaaataaataagtaaaaatttttaaaaggggcttatcacactgctttttgcttgataactttctccttcctgtggcccttacattgagtgggggatggagaagagaggagagacacatttgtgagatagatataaaattcagctctcccagcagtgcagggccaaggcagtcattggttggtaactgtctctctggtacgacaagcctggccaggtgtccaactggtcccgcaggagcctgggcactgctggtccctcaactcatggacaactttccagagttcttcctcccttccagattgtcacctcctcctctgtgagcttacccatctctgcctcccagctcagtgttactgttccctaaggttctatcctaaccctctgctcttctctcactgccatcactggggaaccttgtttcttccctttgcttcagctaccagatctctctcctgagccacgaacccctactggacacagcaagcacaatcttgaccatttatcaagcatccactctgtgccagccattggactagaggctatttcttcaggtataatttacaaacagtgaaaagcacaggccttacatgggggagtttagtacatcttgacgaatgtgtatatctgcataccaacaaccagttatacactttgtcttttaaaaatttcaagtcaactcaaattgttatcctcatgtttatagttgaagaaacaggctagatgaagttgagtgatttgagtgaggtcacacattaaattcatgggggagctaattgcaattacaatactgatttaacttttctagaaggtagtgctctgttttggatgataagaactcagcatgttcaaagctgcacttggcatttctttaattcagttagagctattgattccaaactggcctacataaaaagagaacttgttggctcatgtaactgaaaagtccaggaaaatgttcaggcacagtttgatcaggggcttacatgccactagatccgtttctctggcagtacttctggactccacttcctctgttttgagatcattattagaagcactttcccctcacagtggttagaggcctcgtcagctcaagctgtatggactcattcaaatcctgccagggaagaggagggaaaggaattagacagtgtgcttaagtcagtatattatccctacttttccctggaattcttttacccaatattgaaaattctggcatcagggtattataataaacaatgtatagtgtagtgactttataattcttttaatagaaaaggaatgaaatctgtttaaagagaggttctattcatttacttctctaagcatatggtttcacttctcaatgatcatatttggccctaaaatccagaagacagtttataaatttagggaaaacacaggaaaaaaaaaactagctcccagaccaacatattgccaaaacttaaggcaatattgtgcagtaaaattttacaatagtttttttttttttttttgctaaatgtgttataattcagccagagagtcaataaaaagaaaattatttcactatgaattatgaaaaggataaaatgaatgtttagtataagccaaggatttttccttctgcccttgtgggaccagttggacacttggccaggtttgtcttgccaaagagatagttaccaaccaatgactgccttggccctgccctgctgggagagttgaatttttgtatctatctcttaaacatatctgtctcctcttctctgtcccccacccaaggtatcctcttcctctccccaaaacattattttttggattagatgagatgacctcattgaaaagtagtttccctccagacactgaaatgttaactattactttcgccaatacttctagggaatggaagacatcctacgctgcttcatcaaagaaggcaatgctgaaatgatccgccagatagaattcatcatcaagcagctaaattccggtcagtttgatgcaagaatctttgatctatcttttgaattattcacatttgccagaaagacacatggcatttcattcaagaggcctttaggaagccgggcacggtggctcgtgcttataatcccagcactttgggaggccgaggtgggtggatcacgaggtcaggagttcgagaccagcctggccaatatggtgaaacgctgtctctactaaaaatacaaaaattagccaggtgtggtggcttggcctgtagtcccagctactcaggaggctgagacaggagaatcgcttgaacccaggaggcagaagttgcagtgagccgagattgcaccactgcactccagcctaggtgacagagcgagactccatctcaaaaaaaaaaaagaggcctttaggaaggtggggagacccaagtgaacccatagacaaaagttcagccaggtaggctgagcgtggtggttcacacctgtaatcccagcactttgagaggccgaggcaggcagatcacttgaggtcaggagttcgagaccagccttaccaacatggtgaaaccccgtctctactaaaaatgcaaaattagccaggcgtggtggcgcatgcctgtagtcccagctactcaggaggctgaggcaggagaatcgcttgaacctgggaggcggaggttgtagtgagccgagattgcgccattgcactccagcctgggcgacagagcgaaactccttctcaaaaaaaaaaaaaaaaaaagttccgccaggtagtcaaggccagattgtccaaagattaacaatctcttatcgtactctaggcatatagtcaacaaaaagaacttagaagcaattacagaaaccctcccctaaccttgtaagttctctttatgtggcctctccctttcccctcctaaatcctgccccactattaaggtggcttccccagggtcctggggtcagataatgaaagcaaatgccactgtaagaaacttcatcattttcccacttttattcattcactgcagaaaaactgatgttgccaactgcagtgtggaaggaggcaatgtggtcctcattctatccagcctcctccattaccataacaacccacatcccatagtaagcaggagagaggaaggccaggaagcctgggatggggcagaggtggtagggaaagctcttcggctgtttctgtggactcctgacatcattcacctgccagaggtaccaagcactgctggaatccggggccaggtttgtcactgagtctctctccatgcccttccctgacacccagcagtccacatccctgcaagtcacatgcgtgaatcccttctgcacacgagcagaaagtgaagagtgagtctcaagagagctgcttggccaaggccagaagcccccaggtggcctttcttctagctcagggttcacagtctggctgtacagggcggtcacctggggagatgtttaaatctttaagactgtaccccacacaaattaaatcagaacctctcagagaggggatttcaagctcccagttggggtctcatgtgcagccaagggcagagcctcactgcctgggtcgcagaaacgagggtgtccaaggggctcccgatcaaaaggaggcagctgaggagagcagccagggagctttgaaacctttgtcctttttaggctgggtgcccatttgccttgaatatctcttctttgggttgtatggaacagctataattcatcccaaattcaggtgggcaaaaattagaactttattttttgcagtaacttcatttctgactctcagccctcattctggcatattgaaaaaaataaaaataagacctgaacctcagtgctgcctgaggttgctctcctgccttctctgggtaggccacggtgtgggggcggaggattgttgcacatccgcgccatagtcatcagctgtgcccagccctcccaggccaggagttctctgcattcagcctgagaatcttcttcaaggccacctgtgtgttttagtccactgagatacatctgtctccttgtcttccctccttcctggcagccaagaagcagggtgcaggccccctttactctctggcccaaaaaacatctttttctcttttataagccttgcccttggaccagcctgctagagtgggataaggggacaatttacacttttgtaagggatgtctctggaagaaattgtgttgggcagagctaaaccttctaaccctgggcattctggaaggcttgggaaatacctacttagttcagtaagttactgtttaaataaagagggcctaaagtatttatctttctatctcaagcacctaagttattctgtatccataggacagcggcaggagcccgccactttgaaacaaaattttacagtgattgaacattcagatggaagaccagacacacaagtacctcgggacatccatcaccagcatcaaatcaaagtgaaacccaggaggagagcctccatcctgtcttcatcctcaagtggaaattaatagcagagtacaaattgttgctagtgtatcagttcttaagatgtgtgaaatggcattgccaccatctttatttagattattggtttccttgttctatttcagtaaacttgaaaacatctctgtgggttttcacacgtccaagtccaatcacagtcttctagcacaatttttccagtaaagttttaaggtcttcaagtattaaaattcaagtatattttagcgacctaaccccacaggtggggaaggactattctggcaaagcctaaaggaaaattccagctggtgacattgacaacgccgggtgagctgccaacagcaacagcagagagatttgtcccctggcttgggcctggaccacaatgccagccctcagggaggggaaccagcaccagagagacaacaggggcaccagccaggtcactgggcaggagcaaggcagagcccccgggaaaggaatgatactggccattctagccccacgtgtgttagatatcggagtgcgggcacctcatggagtgtggaccaactcagggaacaggatgggagatagtcatcccagaaaggagctgaggtctacaaggcacttcacttctcaggacaggattattctgggtagtgggatgagtctgagccagcaggccttgaggttatggggtcaggagaaggggagctgggcaggaggaggcagagaaagagaagcgtggctgggctgtctgtggccttacaaaatagccaagagtcttaaaaaaggcatttctgtattcgaaaatgagcggtttataactgatgagtacagcagcacttcctgaaggtggaatggtgtatgctgttggtggatagggaagttagtcattaaacttcagccagaaagcagagtggcatcacatcttcatgcctgcacagtagctttctagactaaatggcattccacaacagtgctgcgacccgtggggcatgcaagcctcagtgagcagggggacactttggtgtcccactggcctcggtccagtgaagtcagtggagtccttccctttagaacgagcgttgggttgagaacatgggtttctacatcttccctcctgggaatggtttggtgtttgatcaaatgtgggtgcaccctgcctgccactttacaagctgggtgctctcctcaagtatggctttagttccttcttttctcctacttcccatttgacttcctttcttctttcaggctttctttaccttcatgtcatttgttcaagaaacaagtgataataagaaagatgtagtagggatagagggaggagtaagtcagctgctctgtccccagggactcacagttcagtgcagtgggtgagagacgagtcagtaagcattcattcattagtaagcagcaatcttccagaagtggcgtgaactgtcaggagttctagataaaacgctgagtgtgttcggggaggaagagatggctgctgagcaaggggatcagggaagacttcgtggaggagaaagtaccaacacctctgcagtgcctgcttcttacctggccctaagccgggcgcttcccttgtggtgtattgtgaggtcctaccgacaaccctgagaagtggctggtacaacccccattctacagaggaggaagccggggctctttctttctgtaactcctttgtgctaccaacttactgctcttttgtaaattcttaaaaagacctagcgatgaaccacagagccttcaggaaccctacctgccatgaccaccacccataccgcccgtggaaaaatcatggagtttagagatagactcggcttgaatctcagctgcctgccacttactggaagtgagaccaagaagtctctctttcctctctgtgcctctctgtaaaatgggggataatagtcaacaacatatttgtaaggattaagtgaaataacgggtatggcagaatctagcatgatgccttgaaataaatatttacttacttttccctaaattcccctaaaattatatgctggcttttaattttccccatgctactataatcatgttctggtaaaaatggagagatttactatttaaaattgcttaggatgatctcagacagtgactgaaatggttgtgattaggatggttaggagcatgatgactttgatgtaacctcattctcattaaggtgtttatgtctctgcagaggctgacagattctgtggaccaaggctcccactgtttatccattattcattgattctttttttctttatagaagagctaccagatggtgttcttgaatctgatgatgatgaagatgaagatgatgaagtaagttggaggttcttgacaccacatagaaaacccataccaaactattctctctttcctgccttgacaagttagtccagaaatggagatttttcattcctgctacactatttctcacaattctgagggttggctaaagctcagctgggtggtggttcgggtctcacttggggtctcatgtggggagcccagcggccatgtttgaagactcccacactcattgggttcacagcagagacgcagcattgcatgtcattcgagtttcatgggaagctgaacaatgaccattcttctgtgtgagcttttgctctgaaggggcacgagcctcggcctgtcttcctcaccggtgggagtgctgggcgtgtaggcgcctggcgagagtctctggcgtgaggggtcctgggtttagttcagagctaacggaactgaccagttttctctgttatttgcattcttttgacttgtgtttcctcagctgtgaaaaatctacttgcctggtgttttagagcatgaaggtttagaagttaatgtatgcgagtctctgaaatgatgtaaagaatggtgactcagggactgtagttggattttcagatgacaagattttacatggttttccttcagatacctaggaagaaaagacctgttgtcccctctggtcatccttgatttgcctgccttcatttgcagggagcagttactcctgcagtgaatgctggaacattttcatctattttggggggagcattcactgaaaaagtggatgtcagaggatgtttttttgtttggagtcgtggcctatcagcttgtaaaatgtgtaaaagccaggtttttgatcactgatggcatcagttgggaaagaggtatttaagagcccctgccagagaggatctgctaagatctgctgggagatgcttcctcagcaggcggcctctgtggctgccgttttcttcacaggctgcaggtggcatcagcgggtacgtgctcctgctggctcttcctgccttgtccagcagtgcagagcttgacctccagataggggtcctggcccctatcatcttctccaggcccctttgtttacaaaggtggaggcagagggaaaaacaccagcttgagctcacacagagagttgatggtggtaaaattgggtttagaacaggagtcggcagacactttgtgtaaaggaaaagataggaactattttagggcttgcaggccacacagtctctgttccaaccactcaattctgccattgtaacacggtggctgtcagcagtacataagtggctgaacgtggctgtgttcctgtaaaactatttatggacgctaaaaatttgaatttcatacaatttttgcatgtcattaaatattctttcaaatacttaaaaacacaaaaatcattcttagctggcgagcataggaaagcaggcacctgactcgtgggccattgtttgccagcccctaggcagttcccggacttgggcagccttctcttgattataatgagtcaccacctttgtgcctggcccttcaatatcattctaaatgatagtttaaattaatatttaattatttgtttttaacaactttttttcattgtgtcctaaagtttgtctcgagatctgttttcttcccttcttgtatcatccctttgggtttttcggtttgctttggtttttcattttgctttgtttttgctataaatcctgtttttatcttataagggaaaattcattttgttcaactgttctagttaatgatgagaactcaatttctggaaatttcattctgaaagcaattgtctactgtaaatgaacaaatacagaagtcttataattttctggacttttgctactcttttaagaggttgatgtttgaaaatacttgtgataactagaattttcagaagatttctagaagaggtttagttggaaaattataaggaaaagatctgtcatttgggccaaatgggactctgtgatgaaccccgggcagcagatgggggctccttctcccaggtaagcctcactgcgcatcaccggtgccagccggggcagtccgggcacagccggtcttgcctggattttactcagctttcaccggaggctagcattacgtttataactgtctttcaaagttggagggaaaaaagagagtgacagatcttaggctaaagaaaatttctaagaatcctttgagaagtagcactgttgttggaatgtggttatcacttcccaaggtgacagctctgaaggagacagcaaaattatttgcaaggtgttggagtcataccttatcttgcttagcagtgtaaatgttctttcatttaatatttagacccaaaacacagaaaaatgaaaccactgttttcagttagctgcttagcaactctaaagataaaatggttctaatggggccaggcacggtggctcacacctgcaatctcaacactttgggaggccgaggtgggcggatcacttgagaccagcctggcccacatggtgaaaccccatctctactaaaaatacaaaaattagctggttcatggtggcgtgcgcctgtaatcccagctactagggaagctgaggcacgagaatcacctgaacctgggaggcggaggctgcagtgagctaagatcctgccagtgcactccagcctaggcaacaaagcaagaccccatctcaaaaaaagtggggggctgtagtgggatggggcctgagaccagggtaaattatgctcactctaaatcacattgagctgaaatctgtgcgctcacaacttccaccactgctatccctgcttcactggaaactctcaagagaacccctgatgcaaagtctcgtttttctctgtaatttataatgacttgatctaatgtgctaacctaacaaagttatgtctgaatatacatacgtttatatactaaaattttaaaaaaaataaaggtagagctagaaatgcatcttctgatttatagactgtctaggatataatgtcaaatagaaaaaggaaatcataaagtaatttgaccaataatttcggaaaaagcaaatgtataaagacacagggctatggattatgtatgtgcctatgtagcggaaaggtgtggacatgtacgccctctttgctgacattataaactgcaaggggggaataggaataaggaagtttgggtgaaaaatgcagagaggccctgaggctcctcaagagagagaagtgagactaggacacggggtttagtggcgtggaagtcagttgctgtgcatttttgtgggttgatggagcaaaagcgaaatgaatggattgagggccaggtgggaagtgagaaaatggcttaagaagtgtatgctgctcctcgcccagtctggctgtgcacagaagagcaatagtggctgaagggggcatttttgtttgttttaagatgagagaaacctgagcatgttaaaatgctgatggagtagctccagccgagagggagagctggaacattcaaggcaggaagagtctacaggatggcattgaaaatatgggtgttttcattgttttctaaaccacttatactttcttggcccacaaagccccagacccatttaaacctccagagaaacaaaaccatcattagatcagcttggacaatacaccccagggaatggacaatgacagctgttatttaaggattcaaatgcatctcatttagcacttcagagaaatgtgttacctgatgcatttattttatatgaaacagacgtaatatgttacaaaagggctgttggtaaatcactaagcttaggagcctggttccgttgttctcacccccagtgactcaggtttccttactatatatcacagccagtttccttgtatggcttccttaagtagaaatgcaagaccttcctgtgctattctagaagactgattttaagacaaatattctcgcctcttgacaaaataggtttaagtgccaggtgaggtcagccgtggacatttacttgctggttgccatgtaagtgccaatcgtatgctcagcaatttccttctatacaaagtgctcagatctaagagttgctcatatatttactcaacaaatatttgagggcctcgaaataacactattgtaggaactaatggggaagggatgcaaaagaaatctaaaagagtatctgtggtttaaaatacctccaagaatttccagcctagatagggaagatcacagtgattctgacaacagcagctcccgcctgctggcagtgccgggtgccaggcactgttctaggcgccttatgggtgttcagtcatctcctcttcttagcagccctgtggtaggtgctatttttattcacatttcacagatgaagagacagagagaaaataggtcacttgccaagttcacacagctaataagtaactgtgatggggctgggattcaaatccaggtggtctgactcagtggtccatgctcctaaccactgccctatattaccttcttgtgagacatacatgaatgcaaaatagcaaataacagaaaataaatatgtgatcacagattcataaaggtgatagacacaggaagtgccacagaaattccaagtactccaggaatactgggagatggctggcgtggggtaaagaggaagtgagatgagttgaggaagggaagggtgtggccagcaggggtggcatcctctgggggagacagcacaagcataagctttatcctttgcctctccactgcactcacatcaacccccccaagaaacccatgttagtgatctagtgtgtgcatgcgctttcatacttaaaagatgcacacacagagtacacggaggtatgtactacacacagatccatatatacttttgtcagtatttgtttttcaaaatgagataacatagagatagaaatacacatacttctacaccatgttgcctttttctcttgttaatgtttcttgaaagtccttctgagttaggcagtgtagcaagttgatactttttaatgctatgaatgtataattttctagattttttgctatttcaaacaatgctgtagtaaaatctttgtaaaaatatccttatttaccagggcttttatttatatgggctcttgctgctggatgaaaaagtatttttttaataatagatttttccagattgctcttttcaaaggctgttaataattcagatttcactaggagaacatgaaggagcctcttccctccatctccactagcaataggtgctgttactctatttttttttaatgtttttgccaatctggatttggatttgctacattgtacatttccaatttcatatcctttctgtttttttcagttgtgcttctttccaaacccttttcaccatcattacaaatgttttaaagatatattttttctaatctcttttgccacaaatcttttttaaaattttttttaagttaaagattgaggcgggatgtggtggctcacgcctgaatcccagcaatttgagaggccaaaacaggcacatcacctgaggccaggagttcaagaccaccctggccaacatggtgaaaccctgtctctactaaaaatacaaaaatcagctgggcgtggtggtgcacacctgtaatccaagctactcggtagtctgaggcgcaagaatcatttgaacccgggaggtggaggttgcagtgatccaacatcacgccgctgcactccagcctgggcagagcaagactccatctcaaaaaaaaaaagttaaatatattcgcttttattttatagttcctgggtctcctgtcctggttaaggtcttccctaaccctaaattttacatgtagtctcctaggttttcttttaagattttaattttttcatctaagttgtagtcattaaatatgttatgcataggaaagaaaaacatatatgtttatataaggtttgaagtaaccattctccaatttttggtttcaggagccatttacattcttaaaaattactgaagattctgaagagttaatgagtattttgtctatcaaaattttttaaatgagaacttaaatatgataaaatgttaaatattaaaatattaaataacttaaaatggcaatagtaaatccattacattaatataaataagatattcttatgaaaaagaattatttttcaaaacaaaattttatgaaaaagtgtagcattgtgggtttgtttttttttttttttttttttttttgccaatctctttaatgtctggatcagaaaaacacagtttgatctgggctgtatctgttgtcatatgttgttttgattgaaggacataaagaaaatctagcctcacacacctgtgtacttggaaaggggtgaagtattttcaaagccttttcagatagatatttttgctcaatattactttaaaaccagacaggtaatagtttattaaaagttagttgcaatgtggaattagaaaccaattttaaatatcatttttattggctgggtgcagtggctcacgcctgtaatctcagcactttcggagccccaggtgggtggatcacctgaggtcaggagttttgagaccagcctggccaacatggtgaaaccctgtctctaccaaaaatacaaaaattagctgggcatcgtggtgtgcgcctgtaatctcagctactctggaggctgaggtgggagaatcgcctgaacccgggatgcggagattgcagtgagccaagatcacaccactgcactccagcctgggtgacggagcgagactccgtctcaaaaaaataaataaataagtaaatagtcatttttatcttgttaattaaaatctattgatctattttgcattttgttaatttgattttctgattgttccctaacaatcagatgtgctaatgtatagaaatacaattgattttagaatattgaacttgtatcctacaaccttactgaatttattagctcaaagagttttttgtttgttgtgggttttgggtttgtttgggttgttttgttttgttttgttttgttttgaattccttaggattttctgtataacaagattgtgtcatctgtgaatagagatcattttacttccttttcaatctagctatcctttattttcttgccttgcctgattgtgctggctagagactctagtacaatgccaaatagaagtggagagagcaggcatcttttgcttgttcctgatcttacagtgaatgttttcagtccttctccatctagtacagcgttagctgggattttttcatagatctgattataagattaagaaagtttccctctgttcctagtttgctgagtgttgggttttgttaaatgctttttcttcatcatatgagatgatcattctttgattttttccctttcatactactgatatggtgtatttatttatattgactttcagaccaggtgcggtggctcatgcctgtaatcccagcattttgggaggctaaggccggtggatcacctgaggccaggagttcaagaccagcctggccaacatgatgaaaccccatttctactaaaatacaaaaattagccgggtgtgatggtgcatgcttgtaatcctagctactcagaggctgaggcatgaaaattgcttgaacctgggaggtggaggttgcagtgagccgagattgcgctactgcactccagactgggcaacagagcgagactcagtctcaaaaaaataattatggccaggcgtggtggctcacgcctgtaatctcagcactttgggaggccaaggtggatggatcactgggtcaagagatcaagaccatcctggccaacatggtaaaaccccatctctactgaaaatacaaaagttagctgggtgtggtggcgcacgcctgtagtcccagctactccggagacaaaggcaggagaattgcttgagcccaggaggcagaggttgcagtgagccgagatcgcgccactgcactccagcctggcaacagagactgcatctcaataataataataatcattattattatcatattgcttttcttacttcccaatttctactggcatcctgcctgtttcatattttcaatagctcttttacccatgcaggattttgtattataattcattgatcatttggaaaatattggcttaccaagttttacagtttttccaaattttttgtttgtttgagacgaagtctcactctatcgcccaggctggagtgcaatggtgccatctctcggccagctgcaacctccgcctcctgggttcaagtggttcttttgcctcagcctcccaagtagctgggttacaggcatgtgccaccacgcctggctaattttttgtatttttagtagagacagggcttcactatgttggccaggctgatcttgaactcctgacctcaggtgatctgcccacctcgtcctcccaaagtgctgggattacaggtgtgagccactgtgcccagccccaaatgttgatacattttattatataacataagaaattgtgtattatcaacaccaatagcatcagaaaagcctttaggtattgggaagctattgagctcacaatggcagatataggtttctcaaaattctcattttttcttgaaagtttaaattgtattattgctgacaaatactattggttgttttccttaaagtgacaggctcacttcattaatttttgagaagacatctgctgtatacttaagtctaaataaccatagtctgtcagttactctttcaaatgaaaatggtgttccttgaaaaaagtggcttgcaactttatctcacaagtcccattcctgaagataaccatccgctttagtatagcagtactgctttatctgcctgtacattccaaaagatgggccataagggttaagagttaataaaattaattcctaccagttcatcaaggacagccttaaatgaaactctatctacctgtcatctatcatctatcatcatccccgtatttatctatggtgaaatacagtgactgctactagagtttgagatcgctgccttggtttgtgctaaggcaccagtggttttacccatcattgcttttgtatcatgagtggaaatgtcaatgcatttgttccaggataaaccatgaaagtcagtaaagcatccaacactttaagtatttcagccagtattacttgtgcttcgttgccaagtatttacataagagatctttgtgattagtgactgttgatactggaagattacaagcaaaataacaaatccaggcgtagttctgcagatgagatattaactcagcattcacgtttacagcttcatctttaattcgacaggctattgtttcattggaaagtgacactaatgtgatttcttttgtaactttccatccagcaggcattcagcagtggcagctgtacaaggctatcgtgtgtgtttctctagcgaaggcaatataacttacctaccctgcaaggttctttactggccgtgttttaaaattttgggtggtggggggagaataattttagatttacagaaaaaaaatagtagagaggattcctgtctacccatcatacagctgcagtggctttttaatttctagtttgaaaagtgataaaaaacaaatgttcaatttctcacttttaaagaactcatcacgatttaaataaactcatcactcatcaatatttaaacaaactcatcttgtttaaatagtcaaattctttttcattaaactccgaatgattggtctcaaaattgcactccaacttaactgacgtttacactccaacttaactgacatagttaaatatattctgttacataagttacaataaggtaaattattgacatctgtaaaactgagggaaagacagctttcatcatatttattttttactggcagtttcatccagcttctttggaatagattcctcccttccatgagtcagagaactttccctcccttattacttccctccttcttgccactagttgggattttgattgggactacattaaatctataaatcaatttgagtgttttataccatgagcatagtatgtctccattgttttgaggcctttttatactgtgcttcaaatctaatttaaatacctgatacataaagacttgagtcattgccacctttttttaatatccagaatcatttggagaataatccaatgtgaataaattcaaatgtgaatcatttgaagaagctaattggtagagttagaacagtataatggccaaatcgatacttttcttagaatttgagacaagaaatagaaaaatgtggctgttggtcacattagtgctataatggaattgtaatgaaacacagcatgacagatccaacaaagtgcaatcagaactagctagaccggggcatggaacttgtatacatctcgagagcaagaagttaaattcaagaagatgggctgaacaagataggaacaagctaattgtccaagcagtcaagagtaacaagatcttccaagtgaggcctaagaactcaggcaaggaggaaaaaaaaaaaatagaactcaggcaaggagacaataagaaacaacatgggacttgtaatccacacagaggatctgggcagtgagtcttgaacaacaggggaagcgacagtgaagcttaacacaaagcaagagttttataatcttattcttccttcccttcttgaccagagccacaggtggccttagcacggatgtggagctctagggtgtctggcccaaggatggtgctcagggctggatcattgagttcctctgagagtgcctctccagagggctccagtgcaaacctcaaggtgcccctggttttcctttcccttgccctggtgttctcccctctccatctcaattttgcctgggaacagctctgctccatggaaaagacagtttgctgctcacagtgccccaggggcaggggcgtgccacaccacagggagtcacacaaggaagcactggggtggagcaagaggctgagagaggggtaagtataggtgaggtggcataagcatgctgaggactgtttcgtttggatgaatttcagtgggctctcgagcaaaggggctttccctacttgtctggcacctagccctggggtgattagggcaggtggataatggccaggcgtgtaagagcccaataaaggagatggttggggtgtgagctctggattggttgatttgtatttggaaagcacacttgggggcaaatgttttaatattcctaagagctgactagttctggaaggggcagtccctccagggccaggcaagctccaatcaaagcatcagcgtagagggaatggaagacatggctaaaacatgaaacctccacagcctggcctcactgaatatctagtctcatctccctctcctctcggaaatggactctgggcctgaaggagttccagggaccttacatggccccaaaccccccttcttggttttcccacttcctttatcccatcattgctgtcaaccaggttccagagcagggacagttgactgccaccaggcatctggccataacgttgacattgctccccttgttattcagcccaattgacaaaaactgaagtctttcaaaaggaacttttattaaaaactaaaggaagaaacttagcaaataagagaggtgttcaagcataggttccagattgaaactgcagagcaggtgacatcccagctgaggagcagcaggagccaaggcaccagcctgatgctaaccaaggggggttcactttggccacagctcagggagtatggagggcaagggtgggagacaaagctggaaggatgaattggagccagacagtaaagagtggacactcactgaagatttgtgagcccaagagacgtgagcagagccatgccttcagaggactactctggcatcagtgttcaagttcactggggaccggaagagcttagtgcggcaacacagccagtattttcccagtgcttccgtgtgcaggcatgggccaagagcttccctggctttctcccgtgtattcccctcacccttctgccaggtgtgtgctattcttagccccattttatggataagaaaaccaaagttcagagaggttcagaaacttgtctagggtcccaaggcagtagctggtgggacagagatttaagcccaggctggcgtgagagcctgcaggctgcagcgggagtggggctgagcttggctgatggcagagggtgctcctggaggtgggacctgcaggagttgggaactcaggaggcatgacatgagtaaccaaaggctggtaaccttggaccctaggtagctgggaggatagcgatgccattaacaatacggggaacacaggctgggggtaagagcagatcatgtgtagggcgaaactagattttgcacgtgtcaggaggcacaacaagatgatgtggctagaacggaaaatgatagggcatagaaccagacagttcctgaccagccttcctccaggtgactttgcattccatacgcagagacatactgttgagggtttggggcctcctttctcttcggccaccttcatacgtgacctgtgagattgtggacccacttgaagctgcttctaggtgcatgtccagagagccagaggctagctgctctccatgaatcagtcacctctgatgggtcacccatcgtggccagctcgcttggcatggccagctcgcttggcgtggcacaggctacgcttctaatccccgttacctaatgagtaaagaagtgtctgtcttatgtctgtgttacttgcaggacctttccattatttaaccaagtcaataaagaaaccagtgtttcccaattaaggcttttgcttctttctggtaccttttcagcttctaaattcgtttatttctgcaacactgctcgtgtgctctcagaccctggctgggatgcaccacccagcaggctgactcatggctcctgccctcatttccactctggtttctatggaaatagacatccgatggctcaaaacaaggtgagggcttgtagacacctcatgattcctaggcatttataaaccctatttgtccaacatcggttgccttggaaacaggtgcagaaaaggttttctctcttatctgattttttaaaaattttaccaaagcagtgatgagtttttcctgttatcacggaatttgggaataatagtacattttatgtagtgaagcatatttctagtttttcattatttgataaataaatgcattctacattatttcattttacaatatttatttaataaataaatacgtttctatccatttgatcaaatcactatcacttggtattcaaagatgaaatgcttagcgtctgggtctagaaatatgactggagaaaaaatgtgtatggcctgctgttccttgcaacttcagaattcgaggcatctagggcatagatgtcttgaattctgaagttggaaggacaacaggccatataccactttttacaattttttttttttgcaaaatctaagatgttttttccaattgaagttagagtttaagtgatcaaaactgatgtttatgctgaaccttagcaagtgggaaaatccaactaattatttcagtcttatactatcctgaccaaggttcttggcttgcatcgctgcttggttttaagagctcagggtctgtttactcaaattgagccattttatatctaaattctgtgtgccatccatgttatgtaaaatatggagcatgtctgttatagaaaacatagaaatagaagcaattttctgttaatcgtgagcaagtaagcaatgcaccatactcggtttagtggagtgacgaggactacataactaactgatagtcattcattaagcatttgttaggcatggtgtattaaagttcagctatggggccgggcgcggtggctcacgcctgtaatcccagcactttgggaggctgaggcgggaggatcacctgaggtcgggagttcgcgaccagcctgaccaacatggagaaaccccgtctcaactaaaactacaaaattaggcaggcatggtggcacatgcctgtaatcccagctacccaggaggctgaggcaggagaattgaattgcttgaacccgggaggcaaggttgcagtgagccgagatcgcgccattgcactccagcctgggcaacaagagtgaaactccatctcaaaaaaaaaaaaaaggtaaagttaagctatgggcgggtgcaatggctcacgcctgtaatcccagcactttgggaggccgaggtgggcggatcacctgaggtcgggagttcacgaccagcctgaccaacatggagaaaccccatctcaactaaaaatacaaaaattagccaggtgtggtggtgcatgcctgtaatcccagctacttgggaggctgaggcaggagaatcgcttgaacccggggtaggggggaacggaggttgcagtgagccgagattgtgccattgcactccagcctgggcaacgagtgaaactccgtctcaaaagataaaaaaaaaaaaggtaagctgtgatctgctgctaggggcagtccaatctttaaggggaaaagcagagtaagttcacttaaaatagaaagacagaaaagcaggccaggcacagtgactcatgcttgtaatcccagcactttgggaggctgaggtgggaggatcgcttgagcccaggagtttgagaccagcctgggcaacatgatgagacctcatctctacaaaaaatttaaaaattagctaagtgtgcttgtgcgtaactgtagtcccagctacttgggaggctgagatgggaagatcgcttgagcccaagaggttgaggcttcagagagctgaaatttgtgccattgcaccccagcctgggtgacagagcaagactgtgtctcaaaaaaataaaaataaaaatagaaaaagacagaagcatagtgaaagttaatgttgctgtgtggggagggacactgcagagaatttgctatgcagctcactttgcagccggctgtgtgctactttctggcatttattttcatatcctctttcctggtggagtcatttttttttcttttgctgctattcacactaccttttattctgtgttagtgaattgtaagtgctgctgggacagggccgtatcagtgtggttctccagaggctcctcactaccggcacagcacttggcacataccaatggtggggtaggtatttgctgactgagcatgtgccccgtatagaacactgtgcaggggttctgctgggcgcagttgctcacgcctataatcccagcactttgggaggccaaggcaggcggatcacttgaggtcaggagttcgagaccagcctggccaacatggtgaaacaccgtctctactaaaagtacaaaaattagccaggtgtggtggcatgcgcctgtaatctcagctaccctggaggctgaggagtgagaatcgcttgaatccgggaggtggagttctcagtgagccgagatcgtgccactacactctagcctgggtgacaaagtaagactccatcgccaaaaaaaaaaaaaaaaaaaaaaaaaatattgtgcaggggttctgatggttcctttccgcagagaatcccttcatcccttcagaggaatgtaagaaggcagattcacccaatcccagcctggagaattttcacaaagtgcatatacctatgtaattcagacaccacccaccccctcaagttcttgacctcttcttgaaatttatataaatggagttattcagtataatatactcatgtgtctggctcatttgatcaatgttatgtttgctaacccccaaaaaactaccccaaatcttagtggcttaaaaaacaataatattttcctcccaattctgtgggttggcttggcaggtcctctgctggtttcacctggacttactcatgtggcttcattcggctggatgtcagctgggccggaaggttcgaggtggtttggcagttggtgcaggctgccagtgcagtgtgcctcagttctccgccacgtgacttcactcctccagtgagctggaactgggcatctctgagttccaagaggttgaagttggaagcttccagtcctcttgaggctgaggctccagaattctcagggcctcatttctgccaaattctactgtcaaagtcacaaggccagcccagtctcaaaggattagaaaaatagacccttccctgcatgggatgagtggcaaagccacatagcaaaaggatgtccttgccaggatggcaggagtttgtggcggttaaacagtctgctacagggagattcttctccgaacaaaccgtttgaagatagtctttgtgtgcaaaacagccttttacagtttcacacactttttttttttttttttgcaaaatctaagatttttttttccaattgaagttagagttttggtgatcaaaactgacatttatgttggcccttactaggtgggaaaagccagctggctatttcagtcttatactaccctggccttaccacgctctatcctcagttcttaatttcagaaacgttaccattctttttctaacaaaaaagtagtattgtaaggactcaatgaactaatctgtatattatcctgaacagagtgccttgggtgtatagtatacattcggttcaggcttgcttttttgtttcctcctagttctcccgagtggatcaagctctgggaatgttgtaaaaactgacttggctagaattcatctatttaacaaatatgtatcaagcacctgttatatgcccaggtctattctatatccttagtgtttttttctgtctactcattctaccagttactaagagaggagtatagaaatctccaactaaattgtgaatttgcctattttccctttcaattctgtcagttttgggttcatctattgtggaattcatttgctttaagcatatatgtttgtaattctatcatccaacagtgttgaccctttatcaccatgaaatgtcctttgtctctaataatgtctctagaatatttggtctgtccaatattaatatagccacttcagctctctcatgcttgctgtttgcatgacatgttttattcttttactttcaacctattcgtgtcttttaatataaagtacttctcttgtagacaggatatagctagcttttgcttttttaatccagtccgacaatctgcctttgattggagtatttatttagtgtgttcacatttttgacagttttattgaggatataatttatataccataaaattcatctgttttaagtaaatgtataattccatgaattttagtaaatttatagagttgtgctaccatccccacaattcaattttaaaatattttcatcaccctgcaaagctcccttgtgcacatttgtagtcagcccttgcctgggtcccccacccccacaaaccccaggtaaccatcaatctgcttctgtctctagatatttgccttttctggagattttatatcgtatgcatgtggctagtgttttcattttcttttttttgtttgtttgagacagggtgtcactcttgtcacgcaggctggagtgcaggggtgcaatcacggctcactgcaacctccacctcctgggctcaagggatcctaccacctcagcctccttgagtagctggaactgcaggtgtgtgccaccacttctgcctaattttttttttttttttttggtaggacggaatcccactatgttgcccagggtggtcttaaacttctgggctcaagtgatcttcccaccttgacctcccaaagtactgggattacaggcatgagccaccacaccagccatcttttctttttttttttttttttgttttttgtttttgagacggagtttcactcttattgaccaggctggagtgtgatggcgcaatctcagctcactacaacctccgcctcacaggttcaagtgattctcctgcctcaccctcccaagtagctgggattacaggcatgcgccaccatgcccggctaattttgtgtttttagtagagatggggtttcaccatgttggtcaggctggtctcgaactcccgacctcagctgatccgccgccttggcctcccaaagtgctgggattacaggtgtgagccactgcgccaggtcattttcctaatagtgtcttttgatttgtaaaagttttttattttgatgaggtctagtttatctttttcattttttcatttatggtctctgcttttgttgttgtatctaagaactttttgcccaacccagactttctcaaccttggcactattgacattttgggccagataattctttgttggggaggctgtgctatgcgttattgggtgtttagcggcatccatggcctctgcccattagatgctagtattaatccacccctcttcccagttgtcacaaccaaaaatgtttctagacgttgctaaatgtcccctaggaggcaaaattactcctagttggaaaccattggcctaggccaacattgcaaagattttcttttatgtttccttctaagggctttgttgttttaactcctatgtttaggtataggaccatttttagttaatttttgtgtgtgatgtgagataaagatctaaattcaccctcctgcatatgaatatccagttgccccagtatcatttgttgaaaagactattattcaacccgttgtattgctttgtcaaataacacctttgtaaaaaataaattggccgggtgcggtggccataatcccagcactttgggaggccgaggcaggcggatcatgaggtcaggagttcaagaccagcctgaccaatatggtgaaaccccatctctattaaacatacgaaaattagccgggtgtggtggtgcatgcctgtagtcccagttacttgggaggctgaggcaggagaatcacttgaacctgggaggcagaagttgcagtaagccaagatcatgccactgcactccagcctgggtgacagagcaagactctatctcaaaaaaaaaaaaaaaaaatgctggacgcagtagctcatgcttgtaatcccggcactttgggaggccaaggtgggcagatcacgaagtcaagagttcaagaccagcctggccagcatggtgaaaccccatctctactaaaaatacaaaaaaattagccaggcgtggtggcgcacacctgtagtcccagctactcaggaggctgaggcaggagagctgcttgaaccttgcaggcagaggttacagtgagccgagattgtgccactgcactccagcctgggcaacagagcaaggctccatctcataaataaataaataaataaattgaccacaaatgtaagaatttatttctggactctcaattttgttcacttgattcatatgtctagctctatgctagtaccacatgatgttaattactatagctttatagtaggtttcaaaacacgagttcttcaactttgttttctttttcaaaattgttttgtttaatattcatattaatgtaataattgatacggttgggtttaattctgccatttgctatcagtgttctatttatctctttgttactctgtccttcctgccttcttttgtattaagtaatatatgtactgctgccctttgtattaagcaaatattttttagtaaaccattttaataactctactaactttttagccgtatttgcctttttgtttgtaagttggttctagggattcagtatgcatctttcacttgtcacaaactactttgagttaatactgatttattactggtcaaatagaagaactttgcatcagtaggctcgatttctgttcctcttttgtgctcttgttgccatatttgctacatttatgtttattatcaacccggtgctataaatagtcatgtatcatttaaagaaggaacatgtgtgtatgtatgtgtgtgtgtgtgtgtgtgtgtgtgtgtgtgtatctccacctacatatttaccatttccagtgctctgtaatgctggtctcttaacaacaaattctgttttgttttttttttaatctggaattttctttagttcaccttctttttaattgctacttgatttggtcaaaacaccttcatttttgaagcatagtttcactgcatatagaattcttagttggcagggcgcagtggttcatgcctgtaatcccagcaccttgagaggccgaggcaggtggatcacctgaggtcaggagttcgagaccagcctggccaacatggtgaaaccccatctctactaaaaatataaaaaattagccaagcgtggtggcacatgctacttgggaggctgaggtgggagaatcgcttgaacccaggagaatcacttgaattgaggcggaggttgcaatgagccgagatcataccactgcactccagcctgggtgacagagcaagactccatctcaaaaaaaaaaaagaaagaaaaaaaaagaattcttagtcaacaggtgttttttccccagcacttttaataggtcattcttttgtcttctggcttccattgttttgttttgtttgtttgtgacagagtctcactgtgttacccaagctggagtacagtggcttgaccttggctcactgcaacctctacctcccaggttcaagcaattctcatgcctcagcctcctgagtatctgggattacaggcatgcaccaccacacctggctgacttttgtatttttggtagagatggggtttcaccatgttggccaggctggtctcaaactgcgcccagccccattgtttatgataagaagccagctgttaattgcatattttatcattgctcccctgtatgtaatgggttgttttccccttacttttgaatattttttttctttggttcttagcggtttgtctatgatgtacctaggtgtgggtttttctgtgttaatcttttttagggttcatggaacttttttttttttgagacggagtctcattctgtcgcccaggctggagctcaatggcgcaatcgtggctcactgcaacctccgcctcctgggttcaagcgattctcctgcctcagcttcctgagtggctgggattacaggcgcctgccaccatgcctggctgatttttatatttttagtcgaggcagggtttcaccatgctggccagactggtctcgaacacccgacctgaggcaatcctcctgccttggcctcccaaagtgctaggattacaggtgtgagccactgcacccggcctggaacttcttggatctataagttacagtgttttttttgtgtgtgtttgttttggggtttttttttttttaaaccaaatttgagtagtgtataaccattatttactcaagtgttattttctgcccctttcctctcctcctgaaaatccagttgcacacatgttagaatgctgatattgtctaacagatttctgaggatttcttcatttttatccaatgtttgttctcttctttgagctggatactttctgttgatcgtccttccagttaactgattcttttacccttttgtatctgctgttgagctcatctattgaattcttcatttcagttattgtacttttcagctctagaattcccatttggttcctttttatagtgtctatttttctgttgagatttcccgtttttcactgattttcagtattttttttaaaacttctgagcacattttcctttaattctttgagcatatttataatagctgctttgaagtgtttttctactaaatctaacatctgggcccactcaaagttagtttctcttgtctatttttcccccaaggacaggtcacgctttgtttctgctgtatctagtaatgcatttggttgacaaccagacgttatagataacgtgttgtcgtgattctagattacgttttgctctcctgagggctgttgctttcatttgtttggtaagcagttaacttgcctgctcttaaactgagaaatgtgtctcccctgtagaaggcagccatgagtgtgtctatcattttctccaatcccagggtctcccctccataatttaactgttgattgggatggaaattgtgctcagatgcctgaagccagtaaggtttccaccttctgctgcttgagctgtgtgtggattgaggaatacatttgcaagcacaaaaaattatctgcaagttttcccacactgttagcttcctctgggttccttgggttttctgcatgtacctgtagtttagcagtcagagatgtggggagattgtaacatctcttaacctctgtagccctcttgcttccagctgtcccccttcaatttctagcagctgtgcctgccacttgccctctaccacgttcacacctccaggccctggggtgtcactgcctacgatgggaacgcctccaggcaggaaggccatgaacacacagttctcacccagtgccctagcacttccccactgagcaagtactgcttaagttgttgcctgccattggtcattttccagtgtcctggaatgattatttttagtaaacgtatcacattttgcacttgataactgtagagaggaattgcctgacctactcctgttccaggaacaggagtatatgcctagggccagaagtcgttagatcctagggatatagcggtaaaagcaaagcagacatcctatttggagaaagcaagccttcaacaaataagcagagatgatagccaggtgaccatgagtgctttgaagagcagtggggcagagggaagagcaagtggcaaggtcctgaggcagaagcatattgggggccttgcgggaacaggaagaagcagggagggagttggatatgaggtcagatcacctagggcctggggaaggaccttggcttctatcctgagagaggagggaagctgttagaaggtcactttcatttttaagtgatcaaagtgctagtttactaatttacagtgagaaataaaactgcctgagtgaggtcagtaagtcactgactgggctgggctattcctgggacttgaactgagcccaaaggcgctgggaccaggtagccttgtagagctcatgaacatccaggtggaagtggccattggctctgccaagtgtcccccatcctaggatcaggagccctgttcgggtcctgattctgccatgtacaagccttagtttctctaaatgggctaaaactaactgccacgaacctgagcaatgctcagcccagcatctcacccccatgctaggcactagtaaggggttctaacccagatgtgggcataacaaacacctgaggctcataaatcacctggcggtcccaggcgcccatgctccttaaactgctaagtgaccagggactcttcctctcccttacactttgctgtcatcttccagatggtgtctacacactgtggctcatcgttctggaagtcactttcatcttccccttcatttcctttctgctccacatcctggcttaagcctcacacccctctctgtactaacttcccagccttcggtctctggccctcccagcttgtcctgcatgtggccaccagaccatcttcttaaagcagagcttggaccacacggggacatgatcacttaatttttaaattagggaacattttaaacttttcagaaagaacagaaaataatataacagacagctgtggctgtatcccttcctctccctcccctccttctctccccagaattaaccactatcttgaagttggtgtattaattccacagatgattctgtactttcataatatacactgttatggtttttaattttacataagtggctagtattatatgaattgtttactggcttgcttttttcattcaacattatgtgttagaggtttactcatcccaatacccagttcacccacttagctgctgtatgtagtatttcattgtcagaataagcccctgtgtgtttctccttcctttcctgtgttttccacagtgcagcaaagagcttcttcatcctcgtgtccttatatgcccttgagtgcttctctgcagctcacacctagatgttgaattgctgatgcagggggatgagggtctcatctttactaaatcctgccaaattgctccccaaagggctgacccatttgcacattcacatgatgccttttaaaacactttcttgctccccatcacttggcacaatctcaagttgctaacggtagtattcaaagcctcactcattaagaccctgtctacctttatatttttatttatatttgttttttcatctgtaaaaatagggataaatcatcatgacagagatgtgaacagcaagttcatctgtggcccctcatggacaaaaaaaaaaaaaaaagatagtgtcctttccttccttttcttccgtatagtgtccactcgctggtctttcttctggagctatatagaataagcctaatccagaaaaggcagtggcagggggtggcattaaagccaaggctgggacctgtcttaatccctggtaggcatcttattggcaggtgagctgatggtcacagctcactgaggtattggatcacatccttgtcttgtatcatgtgtgcatttgatcagcatgctcttcctgtccttattccaagtccaaggcaacagggaacaggtggggccaagcatggaagcctctctatacctgccagagacccacaaaaatgatagatgcatggttaatacttgctgaatgtcgagtcagtgactggcagaatctgaacaccaagaaagggttcagaagctaactccctgtgtttgagtcctgcctgacaacttaccagctgtgtgtggctttgggcaagctggtgaacctcaccaagcctcagtgttctcatctgtaaagcgagaatattaatacccttttcatcaggtgcttgtgaggatcaaatgaaacaatccatgtcaagtgccaggcagactcaatgcctgtcagctgtttttaacgccgcccttgcgatctagagacagactggcctgactggtctagaggcaagccgaagtctgctggagtggaggttcctcatgtgctgcctggccagaattagagagagccaaggccagggctggcccggatggagcggggatggaaagcagctggcagagaagtagagcaccctcagtggggaaaggaggggtgggaggaggctggtcccaggccacactttgggtagcagcagcctgggagtttttcctgaggttttttctgtgaaactttaagattcatctaaacagtatttcagaacatagacattatattgaataatagttttttttgtctttatgacattcctgctggcatgtaagaaaatcccttcattgggtcaggagtgtgtccagtcctggagtggtggtttcttcttaactagcccatcttcacttgctccaggttggggcggggacataccctgccttggtccctaggtcttttgttcccctttgcccgttgtgtcctgagcacactcttaggatcctgtttggaaggggccctgatttcggttaccctcttcctcttctccatgtgaagcgcggtgtctgtggtactgctggggcactgggtccctctccctctaacctcatggaagctttctgctctttcacttcctgtcccactgagcctccaggtcttctcttattgggtgtattaaatattgcgataagccctgcttttcctagggcgactttgccatcatctccacatttcttgctgtttttgcttagagtacagaaaaagtttaagcaagtaaactgagcggcgaaagcaagagactgggagaattagggaagtaaaggttgtttgggttctccggtttctgtcatatccttatttaatgaactggtctggttgtgaaaccaactgtcataccctgggctgcatttttgtgaatggggaaatgaatgtagagggagacttctccgcgtcgcggggagccctcaaggatcccggacgtgcttccatctgcagtcgtgggcacgtgctcaggaggaaagctgcacacgtggccagggcccattccactggggaagtcagcgcctcacgctgcctggcctggtcacctcagtccaccctcgctctcccatgtggagtgtttttcccttattttcacaaagagtgagatttacaattcagcgttctgagaaggtgtctcaaatttaaactacttatagaagtcttataattatttcaagtggaaagcacaccggatactttcacttgtcatgtgtaaaaccgcctgaacacattctgctctgcattctatctgtaagaatctgagttttcaaatgcatttagtggtcacccttagttttgttttcaggccagttgcttagaatctggtttgtctggagtattatgtatcgaaagcctccagttaagcatcttgtaatgtcataaggtcaccaagctgccatggggaagcttcgcattaggacatctaaattcatctcagctcgagcgccttttttatgaggcattcttaatttcttgaagtaatcagttatcactgagctctaacattagtaatctgatgcattctgctctggtacataaagaccagtaattttagtcaaattcctccaacaatggtatttaagacccaccctaacgaggcatttattcttgagtatttctttatccatcactcccttacttcacaaagtagattttaaaatatgtcgtttcgtttggaattcacaagcagctcagacaagttagcacagtggctggtgcccttgtcgcccagtgcacccagcaccttgccaggcttgcattgagagaggctagcagaattctttccccgagcagggcacggtggctcatgcctgtaatcccagcacttcaggaggctaaggtgggaggaatgcttgaggccaggagttagaggctatagtgagctgtgatcataccactgcactccaacgtgagctacagagcaaaaacctgtctcttaaaaaaaaaaatggggggagaactgatggcagcagtggctcccctcccagctggaaggcctgagttggcattctcagagggtgcctcttggcctcacctctgggtttgcccattattaaaagtccagatacatcctcagagttgttttcatctgcctggcactgattgagaaagtggagcaagcgcctgctatcagcaagcttcattgctgggaggttctctgcttacatttcccaccgcaggtagtgggctcctctgcctgcaggtgttactgggaacggttgaatgaagctctggcttctttgttaagctgcccttcccacctcaactagcgcagctcagtttgcttccgctctctcccctcccaagccctaaggatgcctccgttcccttttcgccggtttcagtgtttctcagaaaccatggcagtgacttgtttatatctacacagtatcatggcgttccaaaagcagagaatttaagaaatttcttccatcagtaagtcatgattttaaaggaggcagccaagtgatcccatttactagctagagaaaatgaggcgctgacaagaatcatgtctttctgaattagaaccttggtacaaaactttttaaaccaagaaccatcaatttggtgatgattttcacctcagttttcttacatctatgcatttgacattgaaataacaatagcgtttgcctgcatgttgcactagagaaactgaggcagcggaagccaactgtccctgttgtgagcaggtcagctgcggggccctggttctgccccaggccccctgctcacactgctaagctgcaattcaagttaacttttattaatgggtagcaaatattaggaacaaatgcagaaactgtcctgtgtttctggaggttagggagggcctatcaattctcagcaaatttaattgtaaagtacttttttttttttttttttttttgtgatgtagtcttgctctgttgcccaggctggagtgcagtggtgcaatctcggctcactgcaacctccgcctcccaggttcaagcgattcttctgcctcagcctcctgagtagctgggactacaggcacacgccaccacgcccagctaatttttgtatttttagtaaagacggggtttcaccatattggccaggctggtcttgaacgcctgacctcgtaatccgcccacctcggcctcccaaagtgctgggattataggccacgcggcctataaagtacgtttaattaaaaaacagctttgttttaattaaaaaaaaaaaaaaaggccaagcacagtggctcacgcctgtaatcccagcacttcgggaggccaaggtgggcagatcacctgaggttgggagttcgagaccagcctgaccaacatgaagaaaccccgtccctactgaaaatacaaaattagtagtggcgcctgcctataatcccagctactcgggaggctgaggcgagagaatcacttgaaccgaggaggcggaggttgtggtgagtggagatcacaccattgcactcagcctgggcaacaaaagcaaaactccatctctaaatagataactaactaaataaataaataaataaaataaaccaaaatgaagacaggtacagtgactcacgcctataaccctagctattcagaggctgaggcagaagatcgcttgagcccaggagttcaagtccagcctgagcaacatagcaaaaccccatctcaaaaaaaaaaattttgtttaattaaaacaaaacgagctgggtgcagtggctcatgcctgtaatcccagcactttgagagtccgagaggggtggatcacttgagctcaagagtttgagaccagcctgggcaacatggaaaaaccctgtctctaccaaaaatacaaaaattagccaggcgtactggtacatgcctgtggtcccagctacttgggaggctgaggtaggaggatcactggagcctgggaagttgaggctgcaatggggcccttgattacgccactgctttccagcatgggagacagagcaagagaccctgtctcagaaaataataacaataaataaaataaaatggaataaataactttaacttgtgattgagatgtgttgtttgctagtttgtgtttatgtaagttgatttgcaagtaaatgggtcttacatatgtacttgtccaggataaagaaacacttttgctggcattgactgaagttagccattgactatgtgtttctcgttgaaatggaatatggacatttattttgtttcttaatgtttcgtattccctcctggcagggaagtagtgtctcaccaataccttggtgaaactgtgattccaatgcccatttccagctggggcctctgaggctctgtcccctggagaagaggtgaaacactactccatgcccagagctccctgccactcactcagaccacagagctgctgctttggttcacaaggagtactcattttcctaaaattcatcataaaatgcacacacaccctttgatcactgagatgttgttattttggtgaagtactctaagccaaggcaacaacctcaatcttccgtaaccgtcccagagttgacttggggtagggcctcacaacaggattacctttaaggaaatttcaggacagcgggtctgctagcacttggcagagctggcaactcaggtgcagcagcagaagaaggtggctgccctcaccatagggcatgagtcccaactagagcttaaatcgcagtggtaactgtgagcctgggccctgggtggggcaagagtggattctccatttgtgattagacaagagaaggggagagagagggacgagaccctgaacttcagatgccactatagccctccctcccattactctctgtgtcctgttgagctcagtcttagccaggcagcagggacccaagctgtccagcctgtacctcctcagaaacaggcttcttctgtggggccccaagaggccaagtcaaagacctgggcagaaaggggctgccccaagcttaaagtccagattcctagactcagagctgggctactgctgtggatttgtcacttctctgggcctctgtttccacaccaggaaaatccacaccaagccattgtgaaagttaagatgtaaagtgctatggaaatgtaaggtgggttccttaattattctatgacaagggacatcaaataaatgcccccaaatgcaagctagcaggagcagcatctcctcagtagccccttccctgagtaagatggtgctgattgttggaaaaggctctggattgatctggggcctgcctcttattctgctggttcaggcctgtctttggggacagcctagagtaagtcgaatccccttttcttaggacagcccatcccaaggtgacaccatctagtgatggcaggtggcactgactatgtggttgagagagtggagaggcggggtagcttcccccagcgcagccctaggacaggcagcatcacatttcaaggcccagttcccagccacaacctgccttccaggcccaggaggttgagccttcatattccttggaaactgactggggcaaatcaaactcaccaaagaccagaacatcctgaataactagaaattagtcggaaatgaagacagggtactcatttttgcagaatagagctttctctgcctgttggcaagtgtcaaggagccaattatagtcattagattgttgggtgggccaggagtcaaagggaaggactggctagatgatcttagggaacactgtcaccaggagatgatggcctgccctccccctgcacccttagaccactccagcacttggctgccaccttcctccagggcccctccttcccatttttccctccatagccagcagcttccctctttctgagttaatatttgtattgctctttgtaatttaacctgcaaaggacagtctaaggttggccggaagctttggcagggacgaggaaggggcagtgcacgctcccccatgattgtgtgtgccgttcggtcggcgttcgagtatacagagccttgtgacatctcacatatgctcgttttttaatttttaactcttctgtttttaattcaagatcagaacgtttccatcactcaaggatccctcatagaaggatcccttttacagccaccgccatttcctccttaacacctggcaaccactaatctgttctccatttctataattttatcatttccagaatgttatagaaatggaatcatatagtatgcaaccattgaggactggcttttttcaccaacatcattctccggagatccatccaggcttgtgtacatcagtagttccttttctttctgagtagtattctgtggtgtgtatgtaccacatttgtttacctgttctcttgttgaagggcatctactgtttccagtttggggctattatgaataaagctgccatgaaacattcatatacagatttttgtatgccaacaagtttttatttctctgggataaatgcccaggagtataattgctggttctgtatagttgcatgtttacctctttaagaaattgccgaaatgtagttgcatgtttagctttttttgtttttgtttttttggttttttttgacactgagtcttgctctgtcacccaggctggagtgcggtggcatgatctcggctcactgcaacctctgcctcccgggctcaagtgattctcatgcttcaacctccaaagtagttgggattacaggcacatgccaccaggcctggctaatttttgtttttttcgtagagacggtgtttcgccatgttgcccaggctggtctcaaactcctgattcaagtgattcgctcgcctcggctttccaaagtgctgggattacaggcataacccactgctcctggcctgtttttgccattctaataggcatgtagtgatatctcattgtggttttaatttgcatttccttaatggctaatgatattgaacatcttttcatgtgcttattgccatctgtatattctccctggtgaaatgtctcttcatgtcttttgcccattttctaattagattgtttgggtattttgaatgttgagttttgagagttctttattttagttactagtcttctgctgaatatgtggtttccaaatactttctccctgtctataactttcctttttatcttcttaacagcgtcttttcaccgaacaagtttttaagttttttgatgaaattcattttatcaattttttccttttatgggtgttctaaaaatgtgttagttttacgtttaagtccatgattcatttcgagttgatttttatgtaagatacgagaattagattgaggttcagtttttttcctacaaatgttcaatttctccagcactatttgttgaaaggactatcctttctcattgaatttcttttgtaccttagtctaaaacccactggacatatttgtgtaggtccattttggagttctctgttccattccattgatctatgtgtctgtccctctaccagtagcatacaatctggactactaagcttgaaatcatgtagattgattcttcccatatattgttcttctttttcaaagttgtcttagcgtgttcaattttcttttcttttcttttctttttttttttttgagtcggagtcttgctctgtcgcccaggctggagtgcaatgggacaatctcggctcactgcaagctccgcctcccgggttcacaccattcccctgcctcagcctcccaagtagctgggactacaggaacccaccaccacggcgggctacttttttttgtattttttagtagagacagggtttcaccatgttagttagccagaatggtcttgatctcctgacctcatggtccacccacctcggcctcccaaagtgctgggattacaggcgtgagccaccgcgcccggccaacgtgtttaattttctttgccctttccatatagattttagaataatcttacttatgactacaaaatatcttgctgggattttgatagaaattcctttacacctgtaaataaatatggggagaactatgttgagtcttcttgattcatgaacgaggtgtggttctgtatttatttgaatttttgatttcttttttcttttcttttttgagacagaattttgctctttttgcccaagctggagtgcagtggcgtgatcttggctcacttcaacctccgcctcctgggttcaagtgatcctcctgcctcagcctctgagtagctgggattacaggcatgcgccaccacgcccagctaattttgtatttttagtagagatgggttttcaccatgttggtcaggctggtcttgaactactgacctcaggtgatccgcccatctcagcctcccaaagtactgagattacaggtgtgagccaccgcgcccggcagatttctttcactagatttttgtagttctcagcatacaaatgttgtatatgttttgttagatttatgcctatttctctttttttgagcacttgtaaatggcattgtatttttaatttcaatgttcgtgtgttccttactagtatacagaaattgattttatatgtctttcttatatcctgtgagctttttgaattcattacttctaggagggttttttgtgtgtgtatgtggtttctttgtagattccttatttctacatagacagtcatattatgtgcaaatagggatagtttttcttccttttctcatctgtatggcttttatttgcttttcttgccttgtcaggactccttttcctacaaatgttcaatttctccagcactatttgatgagataactatcctttctcattgaatttcttttgtaccttagtcttaaacccactggacatatttgtgtaggtccattttggagttctgtgttccattccattgatctatgtgtctgcccctctgccagtagcatacaatgtggactactatagcttgaaatcatgtagatcgattcttaccatattgttttcaaaattgtcttagcgtgttcaattttctttttctttcttttttttttttttttgagacggaatctcgctctgtcacccagactgaagtacgatggcgcaatttcgtcttctaattactgccaggtttgagtagaattccaggttccatgcttggcctggttgacaccagatgatggggggtcccggaaacccactacgcctccactaatgcctccctgcctagaagggacgagagtgccccgtcactcactgcgccccacatggctcctccaacaccaccccaggaagggtgtgaggggcatctggtcactgccaagtgtgggtagaagtctgggctcccacctggtcttcacttacattgtggggtgggggcctccttaccacccagcagggatgaaactgctgcctacccagccttctctggtatagagaacccaccgccaggggtgttggggtgtgcggcccagcctggtgagggtacagctggggctcctgaggcccttgctggcgcaggtgggagtggagctaccatattttctccagtgtttatttcctaaaatcttcctgtcatgccagccttcccctgtcaggtcctttggctaaaggaagcaggctttgggtaaaggaagcaggctttggctaaaggaagcaggctttggggggctttttttgttttcaccattgacatttctgggttgttggtttcttgggctccaggtgtggcatatatgaaacaaaaagaaaacccaggcaacctgggtaacctggcaaaacctcgtctatacaaaaaaatacaaaaagtagccggatgtggtggcatacacctgtagttccagctacttgggaggctgagaagggaggatcacttgagcccaggaggtcaagggcacaatgacctgtgatcatgccactgcactgcagcctgggtgacagagcgagaccctatctcaaaaaagaaaagaaaacccagggaagtcaccagctgtcatccttgggtctcaaggcccctaggcagtctgctttcatctctccatctttcagagtcactttatgtttcttttataggtagtgtccagtgtttttggttgtacgtagtgggaggaatatggaaaggaacatccactgggtcttcccagaagcagaacggtgctgccctttttgctgagtcttgttacttattggctgtaaacgttcttgagatgagcagacctgttctagagttccctatcccccataaggcctgtgtatgactgactggctgttctatatggtgccttgatctcacagagagagaagttctgagaactgtgattaggagagactttaaagagccttctggaacctccgcacaactaagcagtggaggctccctagctccctagcttcctgaagaggctggttggccttgtccctttggtcttcatggagaggttgggagcagaggcagactgcccctgagcccccttggaatataagcctgcaagttgctgtgattggccgaggccttcttgtttcatgacagctacacattctggggagccacgccttgggagcttgtgtcagggtgtccatggcattcaccccatgtctcctgaaacaggaggaccatgacatcatggaagccgatctggacaaagacgaactgatccagccccagctcggagaactctcaggagagaagcttctgaccacggagtacctgggggtaagtgccacacaaagggtggggatcctgaaacagaaaggccagatggacattgatggatttcgtgttttcagtgacacagagggtttagtttggtttgttaccatactgtatttatgagaaggtccatgttagccagtctgctctcagtggccctgaaatgcactgtggccctagctacctgtcacaagtagacaggtgtacggattggggaaagatataactagaaggcatatgccaggggcctttggaacatcagaagatatgcctggccccagtagcaattgcctaccatcccactttttaatttctgcatgccttatgtattggaagggaatactgaggtagacttggaagtccttggcgcagaggtgttggctgaaaccatcatagcccatgaggttacccactgaagcacagtgtggagagagagtgggggctgagcaaggaggggcattccagcagtcaggagtgggagaaaggagaggacccgagaaggccagaaagtgagtagtcactgcgtcttcaggagaactgaagagggttatggaaacagaagggagaggtgtttcaggatggagccagtggtcagtgcaagcatccaagaggcctgtggagtcaccatctgggatgggtccttaagctgacctgtgagagctcccgttggctcggatgctcagccagctccagaaccactggcttacgacccaccagctaaatagggcaggatgtgagtcaggaggaagcagccactcctcaggagaggatagcagtgccagggcccgcagatatctcagagagcaggtaggggggcctggtgggatgctggagtgtaagggtctggaagggaggagcaattgccaggaaccaggaccaattcagactgaaaccctgtgtgggacagctgagcacatagggtagaagagtcactaaaagaggctcctagaactttgaagctggtggttgcttcagtcagttgtttggaccccaaagtcttcctcacggccagcaggttggtgttggagaagaagggtggagccagcgtctcaacagttgactggcacagccagagccttgggaaggagaaagacgatgcatgcaggtggcctgaggctttatgggagcaggtggaagcagaaagtgcctgccaggtcccgttgccacccccaacccagacccttggcacctccccaggacactgggccccctggtcacctggccctcatctcttcctcatcatctgtggaacttcagggattctaggctggagtgcagtgcttggtggtgggacttcaggttggagagagagccacagtccagatcatgtggctttgtaggtcatggcaagggtttgggattttatttacaagagctaggacgccactggaggtgagagcaaggaagtgactcggtttgactcatgttctaacatatccactacattttcactctgctgctttgtgaaggcagggaggtgactgatggaggctggggggcggggaaccaccgcgaaccccttcagggataggggttgctgggcagtacctgccattccttagaacatctcaaggattaaagtagtctaattggctgtggagctgtttacattaggtggagcagggaggtgctcaggaaaggtcagaagtgcagccgtcaaggttccaagttgttgatggaagcctaaggcttgactaggcctctgtcgccctttggaagagcgctggttttgtcagagacgcggctccgtgtgattggtttcacaggcaggcggtgaggaaaacagaggaggcaaattggtggggcttcctcagagggcacgtgttgatacctgttgagaccgcgacgcatgtacccctgaccacactaccgcacagacagacacgcaggcacgtaaacatgagcaaggatggccatttgcagccaggtcagacagaagcttgaatacagcgctcagttaataatctagaggacctctccccggcaaaatgccatgggggaggatcttctgttgatatggtaaacatcttcagtaacaacaaaaaagcaaggtgcagaacgtggtgagactgctagtttaatcatgcagattggtgaggcgcaaaggcacagagctttcaaatcaatcagtaaccccagtttaatggcatctggaaatggtaccatcttaccataatatgcagttctaaacctcctaaatgtttatggatgatccttttactagaaggaaaccatgggtggacatgtgagtactgagaaacacagaaagaatccactgtgaagatgggaagagccagtacaatttggtatttcccgtggctgcagtaacaaagcaccactaactgcagacttaaaacagcagaaatgtattctgtcttcgttttgaaaggcagaaatccaaaatcaaggtatccttagggctcagctcccccgaaggactctatgggaggatccttcttgcctcttccagcctctggtggccccaggccatgcttggcttgtggctgcaacatgccaatccctggcctgccttcacatggccttcccctcttctgtcttttgtaaggacacttgttcccccgggtgacccaggatgagttcttcctctcaagggtccttattacatctacaagggtcttttttccaaataaactcattcacagtttccaggggtcaggacatgggcatagcttctgggggccaccattcagctgaccacaccaggtcaccataggatctcatgaatattttgattagaaaatttaacgtggagcagtaagcgctgaggccggatgcactcccagcactgcccctgttcatgagtcatcccccaccgccctgtcacccggtcttgtgatctgacattgccagcctgccagcctctgtgtgccgggttggggatctcagaagatgggattcccaccttgtcatgcccttgctcttgtggtgcgtgaaaagcctttaaattcacatttttgtcgcgttttgtgtgtgtgccaagctgaggagctctgaccaagatagaagacgtttcactgggaaatatgtgcctgaaagtcatgatccaggccccttgttccgatgtactgggtacattgcagatttttcaagatgactctaaagatgttggcgttttgaaacattctgtcagaaaattgtattcaaaaagctttgagtgaacctgtgccatctgcccaacacagcggaatgccgaagaggcttaagacacagctgttaccgtcaagaagttttcagaaggcaccaaacagataaaactgctcttgctgagtggggtagataacagctggtcagtggccagcaggtgtgatcctgcagggtgagagctagtcccagaccactgaatctgggttaaggatagagtctaggccctaccctatacctcctgaccaaatcccaggaaccaatcatggtgcacgccagtaatttaaaaaccaaccagcagcttgggagtaagggtggaggtgcgactggggcgtccgccagagtgttcggggatgggaggaagctattcccaggatcctggaccagtagcccacctgttccctgcagggccacactgctagtccccaccctcaaagtctacccacagctcctctgctctgcagagcacaggctatgcaaaatgctgaagagcacggcgatctcagaaagctagggacagagaataggtcatgcttccaaggcttgcgggagagtagcgatggccccatgagatgtgttgcttactcgtaattctagtgaagccatgtgctgtgttctgctataggctgtgaacgtcagagttcaagactgctgactttcctcctgcttctcctgcctctagtatttgtgaaatttttagtaccgtgcataccgtgctgagtaatcaacaatgcctctggccgggtgcggtggctgacgcgtgtgattccaagactttgagagacgaggtgggaggatcgcttgagctcaggagttcaggaccagcctgggcaatgtagggaaaccttgtctttcctaaaatttttttaaaaattagccaggtatggtggcacgcacctgtggtcccagctattcaggaggctgaggtgggaggatcacctgagcccaggagatggaggcttcagggagctgtgattgcaccactacattccagccttggagtgcaaaaataaataaataaattattattataaaaataaataaatacaaatacaaatagaaaacaattcttcttaagaagaatgccctgacttaaatagctccatcacctgggttaaaggatataaacatttatgacagaatcatagaatcccagcttttttttttttttaatttcatagtgacctttaacagtaataggcagatctcagattaattcagttcatgccatgggccaagccctgtgctgactgcttcacacaactccatttgactgaatcctcccagcaaacttatggggcatcttccactagtatctgcattttatagaggagggcgctgaggctgagaaaggctgagtcgcttccaggcgtcacctgagcccacctgccttttaccactcagccgggccgccttgcagcagcgctggccgttgtcaggtgagtggattctgtacttgcaagttgagagagctgcgacccgtgtgacatattcgtaataactatatgatctatgttttcgtcacagactcagttttgggggaaatgcctatagtgaatgctaattgctccctttccacacttcctttcccctccatcaagtgagaacccaaattcatttagttttcctaagaatccccgaaagggctggttaaagtgcaggttcctggccccacatccagagaatctgaggctgtggcagtgccccaggagtgtgcgtttttattttcccctaaagtggttctgaagcaggagtctgggccctggagacttggcccatttggacagaactcagggtgttcatggagctgcccccagcctgtcttctgcagcatggcaccgtgcagagctgaggccctcctaggctgggctcagacctgggcgagcccctggagacaggagagggccctgggatcctgctgtacccggtcctgctgtgcctagaggggcagaagcatgaggtggcttgcagcgggccctgagagctcctgcccctctctgctcacaacaaaaaccaaaactagaggagaaaaggcctctgtttccaaatattacttttcgggttttttttcacatatgtctccactttggggcatttcctaatcccttttcagtctattattcctgccctgtgtgactgtaatggttgaagagccattgcctctgcttattaggggatttgttggaactgactcaatgtctatacgtgtgtgtgtatatatatatatatatatatttttttttttttttttttttttttgagacagtgtctcactttgttgtcccagctggagtgcagtggcacaatcttggctcattgcagcctccgcctcccaggttcgaggattctcctgcctcagcctcctgagtagctggaattacaggcgcgcgccaccacgcccggctaatttttgttttttttttttttttttgagacagagtctcgctctgtcgcccaggctggagttcagtggcgggatctcggctcactgcaagctccacctcccgggttcacgccattctcctgcctcagcctcccaagtagctgggactacaggcgcccgccactacgcccggctagtttttgtatttttagtagagacagggtttcaccatgttgatcaggctggtctcgaactcctgacctcgtgagccacctcacccggcctcaatgtctatattcttgtgcatgaaaacacaaccaagtaagcagggaaaaatcccaaaccccaaaatatcttgaatccttttcgtttgccatttgtttcttattcttttttctaattacaaaagaaatgtatgcttattctaaaaagtcaaagtaacagaacgtaaagaccaaccctaagtctacccaaccagaggtaatcactatctcttgttgtctttccttatcagttaggattgggctgagctgcaaatagcagagagtcctaccttatcaatccagctaaaaattcctggcgggtgggggctgtcagagcccaggctcttttcatctcttagcgtggccctgcctgccagaagggcagatttaggctttgtgggtcctccagcttacaagggcttgggaggcgtcctctaaaataatggaatgcaaaattaggtatcaaagcgagtgcttctgtggaatgagaattagaacataaatcatagtgaagttcactttttttttttttttttaaaacagtcttgctctgctgcccaggctggagtgcagtggcgcaatctcggcttactgtagcctccacctcccaggttcatgcaattctcgtgcctcagcctcagcctcccaagaagctgggactacaggcgtatgtgccactacgcctggctaattttggtatcattggtagagatggggtttcaccatgttggccagggtggtctcgaactcctggcctcaagtgatccacctgcctcagcctctcaaagtgttgggattacaggcatgagccacctcgcccggccccaattcacttttttttttttttttttttttgcgacagtgtctcgctctgtcacacaggctggaatgcggtagagcaaacatggctcactgtggcttcaacctcctaggcttaaacgatcttcccacctcagccccccaagtacaaattcaaatgttaaaaattggcagataacacaaacattataaaatctagaaaaataatgtttatattaactagctgcttggcaaacacctcatagtttttcttcatatatcttctgttttatgccctttgattgcttctgtatatggcaaattagtaatgttttacaagcataaacataaaaatgtaatgtttctgtctacatatatgaagatgtttttaatgttttctaccgagaaagaaaaaaagattagcctttcctgtaacatatttgatcaaattttcttaatattgattgattaaaaaactttgttttggcctcacatttagttcatggtaatgccctgtaaatctttttacttaaaaattatatgtataggctgggtgtggtggctcacgcctgtaatcccagcactttgggaggccaaggcgggcagatcacgaggtcaggagttcaagaccagcctggccaacatggtgaaactccgtctctactaaaaatacaaaaattagccaggcgtggtggtgtgcatctgtaatcccagctactcaggaggctgaggcaggagaattgcttgaacctgggaggcagaggttgcagtgagccgagatcgcgccattgcactctagctctgggcgacagagcaagactctgtcttgtgaaaaaaaaaaaaattatatgtatttttaaaagacaaaaatttaaatcaacacctgtagaaaataataaaaaataatacaaaagaaaatgtttatgtaaatttttgttttgttttgttttagagatatgatgtcactctgtcacccaggctggagtgcagttgtgcaatcatagctcactgcacctcaaactcctgggtggcattaagcaatcctcctgcctcagcctctcagagtgctgggataacaggtgtaagccactgtgcatgacccgttttgttattaaatttgagaaaaccatcctcaagtttcttccataaaaacactaggccgggagcagtggctcacgcctgtaatcccaacaccttgggaggccgaggtgggcagatcacctgaattcaagaccagcctggccaacacggtgaaaccgtatctctacttaaaatacaaaaattattcaggcgtggtagcacatgcctgtaatcccagctacttggaaggctaaggcaggagtaatcgcttgaacccaggaggcagaggttgcagcgggccaaaatcacgacattgcactccagcctgggtgacaagagtgaaactctgtctcaaccacaacaacagcaaacactatataggggaggcaaaattttacctttctcccttagcatttttggctgggcctgagaattaaattgatgtaaaacagatacacaggagaaaagcatatacattctataagttttatgtgacatgggagctctcctgcagaaacgaagggaaaagaactggcagaacctaaatgcttttaaactaggttgaacaaagagaggcaatggtggaaaagttaccaaattatatggggaggctaaaggaagacaagaatcatgttacccaggtctgtttgtacagaattctctcagctctgacaacatgtggtttttttcttctggtacccggagagcatctttcacatgggagtttttatcgcttgttttcaggaagaaaagaggaagattagaatgtccttcttgcatcaagcgcctttacctcaaaataatcctaagccaaagtggcttattttggaatggcatattctgccaccccttaactgtaactgggggcatttgaagttttcttgcacactgattattcacaaatactctaacaacatagagaattactagagaccattcctacaccaggacagatagcaatcatttgactatgcatggaaggtactgtgaatcatggaaatttttcccactaaatctaaattaaggccaggctgagtggctcactcctgtaatcccagcactttgggaggctgaggcaagtggatcacctgaggtcaggagttcgagaccagcctggccagcatagtgaaaccccgtctctactaaaaacacaaaaaattagccaggcatggtggcacatgcctgtagtcccagctactcgggaagctgaggcaggagaatcgcttgaacccgggagacggaggttgcagtgagccaagatcgcgccactgtactgccgcctgggcaacagagcaagctccgtctcaaaacaaacaaacaaacaaacaaaaaacaagtgtagggctgggcatggtggctcgtgtgtaatcccagtgctttgggaggctgaggaatgaggatcacttgaggccaggagatcaagaccagcctcagcaacaataggaaggcccgtctctacagattaattagctatggtgacgcatgcctgtagtctcagctacttgggaggctgagacgggaggatcatttgagcctaggagttcaaggcttcagtgagctatgattgcaccactgcactccagcctaggtggcagagcaagaccttgtctaaaaaacctacacatacataaaatgaccatgtgacacattaagtttcattagctctggtaattctgccttgatgtcttcattcacatgcctgttgcctcttgatcatatgatgacgggtacacttcctggcacaaatctgtgatcaactcaggaagaaagccaaatgtgcaggtcagccaaatctgcccctacagtgctttcctgaagctccacttggtgacctccacttaactaactggtcaaaactgggtcctatggcccctagctgcacgggagtctgggaggtgagtatttttaagtagacacattgccgtgccgacaaaatcagttctgttggtcaggaaggagagggtgaatattatgtagactgctaacagtgtctgcctcccctttcagattattttctatgtgtacagagatatagatgattgattgatagatagatagatgatagatagatagatagatagatagatagatagatagagtatacctgtatttttttacagaaattcatactgctttataatgtctttaagtgattcacaaatactcaaaaccaattagtaagaaattttttttacctaaattgacatgttgaccaacttttactactgagtaaattgcattcagctaaataatatgctctttttttattgtgcttaaatatgctgcattttttagtagcagaaccttctttcaaataaataatctccgtctgtaacactgatgaaagccgggttctctgaatgagtacaggtggatgtgaggagcccttgctctcctctctccccagaccccaaagcatttctgcagaactcagtataaacagctctgtctcagcaggttgttggacaagataccctctaagatccttcagcccacaaaggcttctttgcaactgaggggcccgagagtaggctgggtggctcacactgcaagcaaggggaggggaagcccaggccagcaagaacaggctgggaagcagctgcactgccaggccctgcacactgaagccgctccactgagggcctttcttcaggcatttttgcaacagaccaggcagtgctggcccgcaggccagacgcagtttccccatccactggagaggaaaaatgccacccactttaaattattttccaggtttctgtagtttaaggagatgaaataactggcagagtctaaaatattctcgaatacgtgacatgttctgtcatttccaggaagacattgggaggagcgagctcagatgaccgctgacagtggggaagtggaggcagaggactagtcacaggctcgagaaaacccgcatgttgactgtttccccttttccagttgccttcttagtgtttctctgtgggagggctcaggggtcctctggcatgagggacaggaaaaagagaaggcaggagtcaccctggagcaccgtgatgagagcgtgtaaagccgaccctagatcctcctggatcggggaagtggggtggaagggaagttacagtggaagcagacagcagtgttaagtggttgcagtgaaaatatcctgccttggtagatttctttagagacagaaaaggcgacgcaactgcattttagtttttatttacgtggcttagttacattccatttcccccaagaagctgggtgcctcccactttctcactctcccaggctttttccctttcactcttctttccatccctccccacctcctagtcagggcagggtttttttgtttttgtttttgtttgagatgctcttgttgcccaggctggagtgcaatggtgccatctcggctcactgcaacctccacctccctggttcaagtgattctcctgcctcagcctcctgagtcactgggattacaggcatgcaccaccaggcctagctaattttgtatttttagtagagatgggatttctccatgttagtcaggctggtctcgaactcccaacctcaggtgatccacccaccttggcttcccaaagtgctgggattacaggtgtgagccactgtacccggaccagggcaggttttgaccccacctgtcacttccctggctgagaactgtcccagggtccagtgaggctcactgaatcccgtaggcactggccctttttttcttcctctccctgcctaagatactagataaacacaaaggaattttcagcagaaatcaaagatgaaattccaatgttcaagaagtttggttttttgttttttattttatttactttttgttttgaaataattatagattgataggaagttgcaaaagtaacacagacagttcccaggcgcccttcacataatttcccctggtgctaatatcttatgtaatttatagcataataatagcaaaaccaggaagctgacattggtatcatccacagactttattcacatttcactagtttgacagtgatttcctttttaaacagtttttcttaagtattaacataatagtaaccatattacaaaaaattgtggcagaaaaaaatattcttagttctactgtcctgtagagccaccctaatcatgttaaggttcatttctttccaaggtctttttgtgcacttttagcacaattgaaagcattgtttagctggacagagtggcgtgcacttgtaatcccatctactggggaggctaaggcaggaagatcactccactgcactccagcctgggcaacatggcaagacctcgtctcgaggaaaaaaaaaaaagcattctttatgtacattattataacctgatttttatttaatgttttaaataaatatatttctgcataacctgttctttatcattgtacatggctatatgatatatatatcaagtgaatatgccatgttttacttatttactcccctgttactagacattagatcatttcagttttactctataataactttataatgaacaaccttgtttatcttacgctttccatgttttggattcattcactagtatttacactcaaggatgtgtgaacatttttacaactcttgataaaatgccaaattgttttccaagacttgtctcaaatttcaatctctctaattagtgttaatcattaaactagtgttttaaactattgggagcagtggacgggatcgtttttctgtcattcttataatagttgaagaatgccaccttgttttgtaaagttgtagtttctaatttctagtaaagttggtcttttttgtttcttctacttactagtaatactttctattttgtgacatggtggtttgaattctttgcccgattatcaatttagtgttttacttactgatttgtaggagctccttagctatgaaaatgttaacctttaatctgttaaatttgcttcaaatacttcttccaagtttgttgtttgcctgttgatttggtttatttttaacatactgcgcatgtggaaatgttcgtatttttatgaaatcaaatgtccatctttttttcccttctcatttttacaaacccagtccttttcagagatgtgatgagttccagtagatcaaccgctttcttccttttcctagggtttgactttgttttaatttatactgctaaatggtgtgatacacaaaccgttagcaaaaaaagggtttttccccacaatttctgtttacctgaataatttgtgacatgatccttcctcatttatttgcaaagcttcttatcattatagagtagtttattcagtgtattctgcttgacttctaggtcagctctctaatagatatttctccagcccttttttctctttccttccaccagatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagca

SEQ ID NO: 1498 - DNA, 529488 bp, Homo sapiens
tactgggtaacttgttaaacacatttattgatttcttgacagtaaccaaacacagtgagtgaccattataaacaagaaaagaaaggcattcgttttgtactttgtgagatctggctgcacctggagagaaaacatacccctttcccaggaacttacaaggcaaagtgcattccttcacgggagcatcacaggggggcatggcagttttgaaacgcaagaagtctgtcgcctgctatctcaggctgaagctcacctcatgtgaatgattgagccatggagtggaattaaagtcatacttgcttagcaaatgcattcctgattgccacaaactcagtaaaaactggctgcaaatgaacaaaacatgtagatgaaggaacaagtgaaatcaaagaatgcagttgcatggagccagggcttagcctgtaaggaaggagaacagaccaaagccagaaaaatgaaattaactcgttaaacacatttattgagctggtaacaataaccaaacacaatgtatgacctttggaaaacaagaaacagcaaatggatcatttctgatcttggcaaatcctactacagatatgtgacaaagagggaaataattccatttccttatagtctgtggtgatatatatacaatgtgtagctcttcaatgtctgtcctttttttctttgtaaattgttgagtaaacagaagaatcataatctagaaataagtgtccttggtcaactttgtcctgctcacctgctaccagcaccctcaaaggatcctaggacactatctgaaattacttgatgcaaagtccgtttgatgccatcagagctgtattttctcctctctcttttggaagaattttgtatgtacaaaggctgaaaagtctcattgggtagatttattagttcaggaaaacggtatcaaaattgaaatcaggttaactggttattttcttctaagacctcttatgaatgagacttttgtttctgaaacttgacttcccatgatggaggttgtaagagtgtgtgtgtgtgtaggtatgtttgcatgtgtttgtatgtatgtgcaagtgcttgtgtgtgtgtttgtgagtatgtgtgagagatgtattcctctgccatggttttgcagacacttttcatgaagaaagggccaatcccaagaatgaatgaggcttgggggaaagaaggagagagaagcaagaagggggacattctaggttacgtcaattcacagttgtagcatttcactgaggtgggattcttcttggctttgttccctacttgaggagccattcatttactgcaaagagagagaaagaaaaaaaaaatcacacatacaacataaaacgaggcatactcaattaatttgcacacagttttagagaattcctccagaggggaagggactgttttgtaaatgcctgcttacttatatgcattccaactactcccttccaattctccatgaccttctaggcctatactgaccaatatggtggccactagctgccatatgtggctactatgaatttaaattaattaaaataaaaaattagttgcatcattgtactagtcacccatccaatgttcaatagccacatatggctagtagctgctgtattgggcagtgcaggatagtcatcaacctatcatgaaaacattcccattaccacagaaagttctagtggatgacactgctctaggctagggatggaaaaacaacagtccacagatctaatccagcacaatacctgtttttataaataaagttttattggaacacagccatacccattcatttagatattatcaatggctgatttcatactacaatgtcagagtgccatagagattttatggcttcaaaacttaacatatttactctctgtcctttatagaaaaagtgtgtagactcctgttgtagaccatatgctctgtttggataggtgtcttatctgtcacccatcacccagctaactgacacatggtaggaacacaatacaggggttttgactaaagagaagaagcaatgaatgagttaggtatttacttttctggtagttccggctggaagggtgtggaaaatatgtagtttgggcatgcaagtgtatctgagagagaaaaaagaagggaacaagggggaagtaggaggaatgaagtggaggatcaaggagtagtggtggaggctgcttctaaaagctgtctggtaataaccacagccctcctatttggggagcatgttattgctacaaagggcttccctatccaggctcttgtttgcttcctttaacaaactgtgaagtagatggcataggaactgtcacgaagaagccaggtctagggggtaaacaatgtggctgggtttgcacagcttgttagaactaggcccagaacttgggtgtcctgatttccagtccagggctctccaagaccccatccttcctccatctttctttccacactgagtgtttaccacaatgattaacagatgtttagtagtaagcagaagggaagagagagagggctgggtgtgcaccacagagttacaggaggcagatgtcaacttaaatgtcccctttagtgggaataataaccatttctagggacatagcactgggcaaagatacactcacaaattaccccattggattctaatggcctgccctttagagtatttgttcatcttctaggggaaagcaggtctttcttccatatacttaaaagctctaatgcttttcactgtcctgttctaacagataaccttgggaacatcagcctttctgggctcttttgaaaaatggcaataaaaagctgtcttgcctgatctacaggggttttaaaggtttgatatatgtgtttaaaggttacatatatatatatctcacatatatcaaacctctacaccttgccatctacctaccgtccatccatccatccatccacttacttacctacctaccaacctacctagatgcattcatacaggtatctgtatcacatatatcaaaactttagaccttcatcaccatgcaaatggagtgtgatggctattgtcatttacagtcatcattcctataatggaagataatgccaggcctttaagaacaggtctaagcagaaagactgagctctagcctagatcctccactctctgagccaccaaacccacctctatactgaagcttctgggctcggttgtttggacagtccttcccctgtaaactgaagttgatattggtgcggatgcagcggttgttgagtggctggacaggcctgaagttgtcactcatgctcagaaagatctgagatggctggttctggctgagcaggcgcaaggaatgcatctgaggagagagaagtggccgtgagatccaaccatcctcttaaatgcactagggaagaaataagaccacagagactctggccaagctaggtggtattggctgtatgaggaaagggctgtataagccccacagagtcccttttttccatgggttcagttgagctgaaggcccattatacctccacacatgaagccagcctttcttctagcttactagcttgtgtatgcctctgaacaagtcacttgcgctctctcaccctcaaatgcagcatccaaaaaaggagcaaatctggttaggtttctctaaggttctttctttctttgatactctttggttcaataattccatgactcccacatggtattacgtggatcatagtgattggtccatgggtcagagctaaactaagctggaccagtttggtttcttttctgtgagactatgagggccaggtggctggactgtttgcagccatgttctgccacaggactgtgaggcaaaagaagacggtctctagcaggagagaagaatgaagtgaatgtgtggtgagaagaggacaacagagagaaagcacttctggggttcccatttcagtgaatttctgatgtcaatttctgattttaaattctctaagatgccctcgtagctctcaaataaatgctttttctaagcttaagtggggagttactgttgcctgtcacccagtgggtcccattcaatacagataggttaaggaacttcaaattgttcaaatggtggtcaggtgggaacacatatcccgtcaaggatattggcttctgcttcctttgctcatctctcctttaatttgttatagactcccacagtcgtagaatgtcagagctggagcaaactcatgtaatttatccccctctcaataaagaagaggagtgttcatttcatagaggtgggtgacaggcctgaagagcacaataagccgtgtagccaagctcacacaggaggacccatctgcctcccatccagttctgatgagtactaactctgtgagatgatccaaaaaaaacactgcacattcaaatatgtgtgcaaaatactacatatcataccacttcctcttgaagactgacacatatattagcatttaagaaggaccccagaaatccttcaacaatggaatctatttaactttttaaaacccaactttttcaaatgcataatgacatcttccattttgcttgcttgctttctgaacactgtagttgtagaatacactctgggaattaatggctatcttttcccactgagacagttgagatgcttctataattagctcaggctaagccttttggatgctggctctttaaacccaggcatatgggttgaatcgtgtacccctgaaattcataagctgaaggtactggtaacccctagttgctcagaatgtgaccttatttggaaatagtcattgcagatggaatgagctaagacaagcttattggggttaggctttaatggaatacagaaggtgcctttataaaaaggggaaatttggacacagagcctcagacacagggagaacaccttataaagatggaggtagaggctgggtgtggtggctcacgcctgtaatcccagcactttgggaggtcgaggcaaatggattacctgaggtcaggagttcaagaccagcctggccaacatgatgaaaccccatctctactaaaagtataaaaattagccgggcgtggtggcacgtgtctgtaatcccagctactcaggaggctgaggcacaagaatcgcttgaacccaggaggtggaagttgcagtgagccaagatcacgccactgcactccagcctgggtgacaagagcgagactccatctcaaaaaagaaaaaaaaaaagatggaggtagagcttggggtggtgcttttaaatgccaaagcacgtcaaagattgtcagcaaaccactagaagctaggggagaggcatggaacagattcttcctcacattccgctgaaggaagcaacgctgctgacaccttgatcttggacttctagtctccagaactgtgaggcgataagtttgtgttagtttaaactacccagtttgtgggactttgttatagtggtcctagtaaactattataataggcactccacatttcagtgatttttttttaacatcattcttctccattagctaaatgaccagagagaaactcacctgcatcctggttatatagacaggtttgttcattatgatccaacttgctgtctcatagcagggtgggatagtcatcgacccatcgtaagtgatgaaactagaggtctctggatatagttcctctatattaagcccctgtagtaaatatgcatcatctagagaaggaaagaagacttaaaaattaggtttcttgagaaagggatggtattgctgacatacatacatacatacatacatatacatatacatatacatacatatatacacacacagatatatatgtatttcttttggaattccagaagactctatctgtcagaacaggctgcagtaacaagcagttgtcccccagatctcggttgttttaagcaataagaatgtatttcttgctcacacacatgatcattccaggttggctgaggcttccctccatgtcattgtccatgctttgggacctagactcttagagcagtaaacacctggacctgtgcggatcacagtgacagaagcgaaagcatggcgaatgtgtgttggttcttaaaacttccatcccagaagtggcacacatcacttgtgctcatgttttggtagccaaagaagtcacatggttaaggctgatgttggggatgcgaggaagcacattccttccacaggatggggccctgagcattggtgagctgtaagcaatgcgttctaccacagggattgtttgaggagtccttgattctagtccctgagatctggactcctaggcattacaggtatcatgagatggacaattaaagcttctagacctgttgaaattcacctggtgaccattctcacttaaaacaacaataagaaaatatttttggatagaaaagtaaatcaggccaaatcctaccatgagattctatggttaagctcaacaactgattattttgtgtgtgtgtgtgtgtgtgtgtgtgtgtgtgtgtgtatttttctctctctcaggtctatgcagatagccttttctcttacaccaatttgaggtattcatacccatatatcttctattactaaatacagtaattcaatggtaaaaatgacataagtacatcacagactatatggaaaaaagaaaaaacaatttcagtcatctaaaactgttactattagcattttggtgtgtttcctgttaatttttttagtcaatgtattggttgtatttttgataaaattgtgtgtattggagttttaaaatatcagttaattgcaatgtatctctcctcttctcccctcttcatgatccttcttcctttcttttagcacgtgattgttctcttctgctggcttcaaaaataccatacttagtattcccatttttctggccattctctctcaggttttgttgctgtctcctgatcttctacctgcttctctcaatgatgcaattccccaaagatcagtccaaggctcccttcttttcttactctatcctctcatctgagagtagctcatctacatccatggcttcacttgccttctgcatcccagtgattccagatctatatctctagaggtatcacatccccaggcataccatgagcacccatcactgtggccagtccaggagacctggagaacacatggcagggtcccaaagcctggctggccgagggatgagactgactctccagccccatggatgcacacatgttctctcgtccatgtgtctaactcccagtgggaaagtactcattcttcaggggttgagggaacctcttcagtttagtattgtgcacatatatggtaaaggaagactttcacatatggctggaacctcacattgactcaataaaatgagtcaggcagatagtaacatcctccactgacaagaaactaaagatcagggaggcaaagtgggctgcccaaggtcacagggctagctggtgactgcaaagtggaaattagaactcagctcttccgacctccagaccaaggtcattttttcattcaacgattattcactagaacctctttgtgctaggcacagtgttaagctctggggacagagcaattaacaagatagatgcagtccttgaccttattctagttggagagatagataacaaatggcaaaataaaaataagtaggctataatgtcacagtaataagtgcaccttgacctgcctgtacttacctactgattaatgctgctaatttattttccttggcaaagatgccctctcctccatttcttcctctagaaattgctcgttcagccttctccaataagaaagagttacctttgccaagggaacttgaatttcagtgttgctttgtcaattaaattgtgaacaaatcaatggagccaatcgtttggaatgatataaatacaatcacaatttgcctactccattcaaagctgcccttcctggcctcctactcccttgatggggtaagggaacccctccagggttccatccaccaaagtctctgaggaagatagcttcaccaagctggatttggagaccaaccctaggaggaaggactttctttcacttttcatttaaatgtttctacctttccgtcaaaacaccaaggaacgaggacatgctcgagagagacacagtgattggaatatggccagcctgggtctgcactatggcctgtttgggcagatgcttccataacaaagccacagtgcccagggcacacacgacgtgagggaccttgggggttacatcaggggccaacccaataagttaacattggatatcagcatttgtctctgactgcctcttaagtccctaagatgtgtcaggcactaagccaggtatagatgagtaggaaataattaagtgaatgcagaaggcatgacagagacaatgacataaatctgcattgggcccagagagaggctgtgagttctgtctggggcgagggtgcggggtactcaggaaggaatgaatcgaggagttgacttgaactgcatctttaacagcaggaggtgatcagtttgtagctgggaatcgggtagggtgtcaaggccactgtagacagagcaatgctagaaaaagagtcaaggaaggagtggtgtgtacttggggacagatggagtgtgaggtgcagggcgatgtggagatggaaggggagggagggctgctgtgagaaatgtggctggtggggtcagcacagaccacaccagaaggtcttcccagcactactgggagtttggacttcatccggaggcaatgcggaaccaccgaagggattgaagccaaggagtagcatgatcacatttgcacttaatgaggcttgctctgatggtggtttggcctgaagattaacatattgaataagagaaggaagcattcagcacatttttgttaaaggtcaatgtgatttgtttaaccaagcttgcacgaggaacacattgggtactctagcatgctgttattattgcattttattttattcggggcggtggggaggagtgaagggggaagtagaaagagaggcattccaggcatgactggagtaaagaaaaggaacatgttttgtttctttgagactgtaaccagcctttgtgctgcagctatatttgtggaaaagattgggggccgaggtatagtgtaggctaggagcaagagtcaaaggttatgctcagggatttatcacacacagcaggtttccaaaacaccgtagtgctgataccccagactccatccactgaggtcctgccaggagatccctctttgtccactccctctccaagatgcaacagtcatcagaggacataggcagcttctgctctcctgacattttcactccccactgtgttccttctgcaaatcttgttaatacttatactctaccttttgccctttttatatcctcacacagcagaacttggaaagacccagagtggagagtgtgagttttagactcacatcgcagttggagtgctgactttgctgctcactctccgtgtgtccttggacccacaggtaaccctctgagcctcagtttctacatttgcaataagcagatggttggagtactttgctcacggggttgtttgaggaataaacaggatcatgcttttcaagcacctagcataaggtgtggtccaggtttgtcacatcctcctaccctgccctggaataactactgctcctctcctcaaggactccctggcttccccagctgggccagtgccctccttttttgctgtatttactgaattagcttgtcaatcattatttgcctatttgactgtccctgctaagctgtgagccttcaggggaagggtttgcatcttgtatctctaagcccccaaatgccagcatgagtccaccacatactgggtgtttagtaaacactgctcgaatgaacaaatgaaatggtttctgctcagcagctctacctgctggcagtgttgggcaaaagcaagggaggaagagacgacatcatttatcagatgaggggaagcatctctgaggctccagtcagcatccttagcttaaatacatgctgcctaccatctcccccctatgtctcacaccctaagacatcagggtgagattgcctgccctgtttccatctccatatgctattaccatgtttccataccaaagactcctctaccttcatatttacattgctgagtcagtgcgcatttaacgtgtaatgtttgttttcatgactcatcatgctgcctcagaggctgccattaaatcagtgtctatcttttaggtattgggatttgaaagccactggctaactttctgcatcttcttttctctctgttgaagcttgctttgtatgtttgataggacagaagcagagggacccaagaaaagaacatgagtaaaacagaagttttcagccctaatgtcaaggcacactggggtgttttcagggctaactaggccaggaactagcttttagtcacaaactatcttgtccttgcagcatccagcagaaaaccattgtttggttcttgtcagcgttatcgtctgggcattatagacagaaagtagactgaggaccaatataccagaagggagattctcctctctaaacttccaaggctctattcatgagtaaggatggcaaagatctagaggaggtcagagttgtttgtgaacaaagatgcaaatttggggtgaagctcagaggccagtgggggagtgttcatgcatgtctctgcttgctttaaggatgtttattggtggaagtgaggacagatgttcaaataaagtttcatgaatagttttgcagagaggtttctctacctatcccctctttctctctctctctctctcagctctctctctctctcctctctctctctctcatatctctatcacctacttacctgtcatatgagaaaatagcttataaagggcaaatcctagatgtcaagtcaagagtcttaattcaagtctgagttctagtggtagctttgccagcaactcattcttccttcatggaaaagaatgtaacctcttacttgaggataccaaacagtcctggaaaattgcatcttcaggtattaaacattctatggatccgaaaccatctttcaacataagcaagcttgttagccaaatttatcttaggtaggtcaaatttttatatgagagtgttgtaattttgtatgtgttggctgtatctttatagtaaaggaggaccccttggatcttgaataatcaataagtgtagaatatatgtgtgtattttatcacccaattttattatttcaaatgactgcagaagttgacagctgaacctttggttttttgacatgttcttgatgaacctgtgatttatcttatactgagttcttagtcgtggttacaactcccaagctgactttttctttttgtaggagacgtacactatgataaaatgcctaggaccacttgggggagtcgggggaaactttccctcagtctgaacttttttttttcagtctgcatttaacaggcagcctctgttaaatgcattgtgcttactcatgtggaccactgatgagatttaatattgcccggcttcctgcttatgaagttcccatttgaagagaactattccaatgagaacaaggcacggtagtttcagagatcaatactggacttgttcctgatcaatatggaactatttggcaattttctcatatagaatgacatttcctcttgtaatctgaggcaaattcaactgaaatgaaaaaaggcaattactaaagaatgaagtaatatgatattttgttttacacaaacaataaatgataaaagggacctctgagaattggattcgtggaggtaagctgctcctgttctgttccttgctgacgtgagtaactacttagattgcaacatggaaagtggtgtgctgcgttttgcattctgtgaaagcatttccaaagccgttcctttgaaatgaaagtacaagttcaattaagcatagagaaaggcaccaggagcaatatgcttaaactccttggtgatatttcgtcacatttaacaccacgtccctctgaggagcggcgcataaaacacttcccaaagaactgagaagtataaggcagttccaagttgatctgtccttgcctacacatgcatcttttagctgaatagaagatctgggggttgggggaagtaaagcaaagttataaacaggtaagactgaaaaagatgctttaaagggcttgtgccacgtgtcaaagcgctgaatctgaaagctctcctccagatgccttcagtggtgtggttttatttccttagaggaaatacattaggacaatagccatatctttttttttccttattttttatttgagatggagtcttgctctgtcgcccaggctggagtgcagtggcatgatcttggctcactgtaacctccgcctcccaagtttcagtgattgtcctgcctcagcctcccgagtagctgggattataggtgcccaccaccatgcccagctaatttttgtatttttggtacagacagggtttcaccatggtggccaggctcgtcttgaactcctgacttcaggtgatctgcccatctcagcctcccaaagtgctgggattataagtgtgagtcaacacgcccagccaccatacctttttaaatttgaaatttgtgatcgtttggattcttattggactaaatgaatgggggcatgcgacactgaaggagaatgaagctaccaaaataatactgtcctaagatgttagaggaaagtgttttatatgcagtgttctaataactgttccctcttacccacttaagaagcctctttgcacttcattggtcactagtttagccacttgaaaacagcataaaatctctttttaaaaaataatgctggcttaatgaaattgggtagataataaaataagaatactactttttatttaattgggattctgttaattaatgccaattaattaacacaagaaaaatggagggatattagccttattccaatacactacgttaaaaaattaaaatacttcaagtaaattaccaatatctcctccagaaaatccattcggaaaatctatttttcaatgtcatgattttagtcttaacccccagtctgttgaaggggaatttgactttaataaaatgggttttctttagaagactttctaaattcagcccgaatttagttcaggctagtttttttcattgtcagtcccagttagagtgttttataagtttcactcagacatatgaaatctaagcttgcaaggaaagtaaagtagtagaatctcattaaatcatcaccatccactgcatggattcaagcacaggagcggtatttcatttaaaacaagcaaattctgttgactctgtgtcctgtattgcatttaccttcaacataatttttatttggcatcatagcaacctgcctcctcccctgagggaagctggatttgatagccaggtaccttaagacaacttagaaatacacgttcattttacacctagtttataccactcattgttcaggcatttgactcattaccttgtttgattctcatgccaaccatctcaacgtcagcattaatatcttcctcttacagatcggggaggtgtttagaagcttgcttaaagtcaggcaacaaaaggaagtggtagagccaggataggagcccagatctctcttcactagaacacactgcctcccatgggtgtggtgcctttaccagcatggcatttagcctccaaaattcccaatcctcttggcgagattctccctctttcctccttgtatgaatttcctggcattgattttttttgtaactggctcaaaagaatgattttgcacagttccccccctttttttttttcctggtcattcattctgtgcccaatcctacaaaccgggcaaatggactgtgtctcttccagctgccatgttgtgatttcaccccgctgcctccatgtgtgcagcagctccctgcaccacctcagtttgctgatgaggcagccacacgggagcctcttccagggtgggattttaaagatatctttagaagtgattttcaatcctaagtcatggagatttgagttgctctttcaaaagtgaggacatgtcccgcctctcttctctatttattcttactctcaggatttcaccaacgtttaaacgccatctggatgccaacgtcttccacatttatatcttcagttctccctcctgaaatccagactcatatatccaactgcctactccacacctcttcttgggtaccttataaacatctcaagctgaacatgttcaaaatttctgatttccttcccacccacggatacgcttcatccacagtctccccatctcagtggatgaaaatgtcttctttccagttgctcaggctaaaagtcttacagtcatccctcactcccctctttctctcacataaaacatcagatatattatcagatatatcagtacatttcttggcttttttttttttttttttgacagaatcttgctttgttgcccaggctggagtgcaatggtacgatctcagctcactgccacctccgcctcccgggttcaagtgattctcctgcctcagcctcccaagtagctggaattacaggcgcgcgccacaatcccagctaatttttgtatttttagtggagatggggtctcaccatgttggtcaggctggtctcgaactcctgacctcgtgatccacctgcctcggcctcccaaagtgctgggattacaggtgtgagccactgtgcccggcctcttggctttttctttaaaatatatccaattatttctcaccatctccctgccaatccccatcagcccggtcatggtcagtgccatcgtctcattatttgggttgctgcaatcctcttctattgtggactctgccccttgtagtctattctcaaccaagcaatgaggcgatccttttgtcaacagatgatgtcactctgcttaaattcctagattgactttttgttacaatgaccttcaaggggcagattttcagaagactgaccccctctagaattaatctctgtgccttctctggtgactatatatgtcagtaatggcaatgtcactgtgtccctctgaatgactgatttccactggaggtaccatgttcagggccaggcaggagttggagagagcttaggtcaggatgtacttgaactgccaaagttcccatcagttctgtggttagtatatgtccctttcaagtggaggcacatgcaaatagcaaaaagatgcttcttcaaactgaaccaaagttggaattaagagaaaaacatgctgacaagtttcatggaatgtgaaaacatcttcactgcaattagttttaagaccctggagctaagctttccttcctccttagggagaaagcatgataggaaggaaaagcagaggaaacagtacccaggaagacctgtatttggatacttgctcttctactatggaagaatatttttcaggaaatgttcacttcttcctcatcttcatctccttggcaggattttcatgttgagcttggccatatggcttgctttggcttgtggaagtggacagagtgagtgtgtgagtttcatgactaggccttaagtcacatcacttatttcttccctctaccatgagaactacttgccctggatatcatcttgatcctagaacaatgagagtcacgtggagctgagctgcttcagctcacttgcagacctgtagctggaagcagagccacccctaccaacccaaggagggagcaataagaaatcaatgcttatcattgaatgcttgtttattacgcagaagttgctgactgatacagccattaaatgtgtgtcattggtcaaatgacttcacctcttgaagccttgatttttcccatctgtaaactggggatggcaatcataccgctctgaaggacttcgtgagcactaggtaaggagcctgtatgtaaagcatagaccttggtgtgtggaaagtgctcagtaagcatcatctccatattcctggggctcagcacgttgcagagtggatactgcatctaaatgagcagagcaaattgaagctatgctggggtgcagttctgggtagcaacagtagaatgggcaggggtggaggttaggtgtccctcagtagcatggtagaaatggtggggtggggggttgatttctgtctctcgaacatttagaaggacagaagcaggataccctgatagggccccctgagttttcttcatcttaacctgaatttatgggccagtgctggcctaacctgctgcctgttggaaagcctcgggagggacttccagtcttatgtttcccacccactggctgtgttctagtgaatgactcctactccagactcccctgcctgccactgggctaaccttctggctgccctagggacaaaagagagctgtggttttctgctgcgcaaatcaattcatttctgccgcagtgtcctgggcaaagcagtgtcagggtcattctcatgaatcggccatcattattcctgcagtgctgctcccttcaggtatgtgacaaaggtcactacagaggacacctcaattactccctgctgaattataggagcacaaaattcctgttattagggggcctaaatcagctatctttccccatgcaggccaggatctctttatcttgctttggctcccctttcttttccctgggccctgagaggtgtagagtatgggggtcagaaggagagggtgctcctgctgtcttctatttgcatttctaggaatgtgtcttcagaggtgaaaagggtgtttaaatgtctgcctgccttctgcataaacaccttaacatggctcaagatccggctccagaacatctttcttgccactccctctgccccgtcacagctcctgaaagaggccattcatccttctattcacccaggccatcaccaatgcttattgggcgtgcctcgtcttaggcactgagacgaagagctgatgaagacagagttcctccctctgaactcttcaccggccttcagtgctctccaggttttgtgcatgtggctccccacacttggaatgcttttccttccctccctccctttcttcctttcctcccttccatctgtcttttccttcttccctgcctccccttcctctccctcccctctcttgctcctcccttggtggcacaagccacatcacttaatattaatcagaccagtgctgggggatgggtggtggggtggggaggaaagtccctctaatgattgactctgcaactggtaatctgttagactgtgtgttggggcttaatgtgtgatttcatgcattttcacggtctctaaattgcaaatccaagattatttgaaaacattttatttaattttcatgcttttttcatcaaaaaagttaaaagaataataatcttttatgggcagttataaatgtgctatttacacacaagacagaaatatctcccttagctgagcaatctaagtgtgtgcttagagaggactccataagaatactaatgagaaaaggcagaatatgcttggagacaacctaattcattcttctgggcaatgtctctctaggtggagcgggattctccaggttcattcctcagccctaccagtctcccagcctctgcagatgggagggacttggcagtgagcacgtggtagttgtagggctgctgtctgggccatctttacatccctggagcttcgcttggtgcctgtcatggggcaggcatgcaggaaatgtttgtcgaataagtgagtaaacggctgagtgaagcattctccatactctcccttggcagtccaatgtgagagctgtacacattcatttttttttcttcacatcaccattggagagagaagcagcagacacagctgagctcctggcttggtgaagggcatgccaaggggatgtgggtgcttggatgtttgccaactgtttttcacttttgtgagaatcattatttacctattgcttgattcagaatcccagacctagaaggactttagaaacttgaagttcaacttttttactttataagatgaatgacagagtcaaagtgaggaaactccttgatgaaggacaaagccaggacttgaatcccagtatcctactcgctcctaattaggtaaagacaatcttttttcctcatattatttctttcatctatgggtgtgtgctgtctcacccaacttttcccaaatcctgcaccttctgggattgctggagatgacagcagcatctttttccttcctccttcaactttgcactgttctctcttttctgcataatgagtctggggataaaacactctggaaacccaaggaaactggacagagtcctctacatccatgggccacacatgtggctgaagagagatgctatcctgtctctgcctggaaaggagacccagccacacacagagaaatggtctagccgagggcttctgtaaatgttgcgattggatccatagtacctgatgagggctttctcaatcccgtaattggcaaagccccaactgtgaccagctgacacggtggagcgtgtcagccagcagagtcccctggctcattaccaatctatgggataacgatgaccaccatagtcataatcattatcaccttaggcatggatgacaaaggcaccctagggacttctgcttgaaatgagctgcttcttagccaaaccctaatctccagagtgactttctacagaactgcaggatcatgaaactgaaaagggcccatggagatcatcagttctggcttcccgccttcaggcaggtctaacctttatagaatagttgctgtggaggaaattgaaccaaacttacttttatatgttattcttgtgatagtatctctgttgagcattcgattaagaaatgggtttgatgaatcagaaacctggaggagaaaagaaaatattaatgactgggcatcactcttgcaggacaaacatctccccgtgacattcacttattcattcatagttactgagtatctaccatgagccaaacacaatgacagctgcaaattcagagagcaaagccagagtccctattctcaaggacagcccagtctagagaggaagacaggtaagtgaacaaactgttctcatatagtgtgaagagtgctatgattgagtcattggtgtaatgatgttggaggaagaccagccaccacctgagaatctaagtcatgagtctgagaggatgggtagaagttaacaaagcgttctggtgatagagtgtgaaaagggatgaaaggcaaggaaaagcatttcatacagaaaatctttacatacacggacatggggaagtgagaaccaggcatgctcatgcaaagacttcagtgtacttggagctgagggtatggggaaggataggaagtgagcctagaaagattggcaggggccagatcatgtcaggcttttaagcaaggtagggactgacatgttaggaaggggaaattcatctacgtagagggtgagacataaagagtacccagaatagaggtataaggaaatggaaaaaaaaaaaaactgaaaagtatcactgctcattattgcatgaattgagtatatcataagccatgtaattcaatcaaccaaccatccatccatccagccagccagtcagccagccagccagccagccacccacccaacaaataaatatttgcagagggtctattatgggccaaacattgtaccagatgttcagggatcagttcccattttatgcctatgcccttatagcttcaaattcctctgttgggagaagaaaccaggtttccaggggcttcagcagggaaccatcattgatgagactgtgatgtggccctacataagaaaagggttttcttaaaaacacctgtttactcagccttttctggggtaccattgttcatcctagtcatttctctcctaccttgcttagctctgctctgtaatttatgtctcagtggctaatcggatgttgtgacacatcaacattttaaatctgatttatctgagggttggaaaaattgcagcagatgattattattattagataagcaacaggtaattttagcttggagaaagcacagactgtttattttccctccatctgtctccctttttgcggtttcctggctgtgttgtggtgagacacacaccaaagggagcttggtgagtgacaatgcccagtggaggtaaaagtccatccctaaatagaaaaagtcccaaattgaatactgctgctcccctcagtgctatattcaacatctactttgacatcctcttcagccatttaaaagatagcttgaagcctgctcctggtgctgatgcaccccatgaaagaaagatggctaggaatatattgtcgtggcaggtaaggaatctgttatgtaccttacttcctgggtgccttgagctcctggtacctggtgagtctggtcagcccttgcgttgggagcagaccattttgagctgattaaaaataattgaaaaatttccaaagtgcacacagatgatttgtgggctctagtgtgttggctgcgtgggtgagaggataaaatatgtacttggtataagtgagcttaagtgggaagttaatggtgtgtgattgagcagcaattacagccaaatctcagttccctgtggtcacagcaagggtgggggatttgtggaggacagagataaataaaactcatagataagcaagtatctccttttagagagtaactccagcttttctacggctcagcttttagccagggtgataactctaggactaaactaccaggatgtggggcttgtcatatcccactcctgcccaccctgctgggaagggaaggcagagagttcagaaggaggggaggacaactacaagaggctgtgcacccttagggaccaagagctttgttcatcttacttctggataccagtgcctagcagagggctggcctgtagtacctcatgctccatcagagttttgagatgagtgaatggtcagtcacagcttaaataactcatggtggagttgattttctgggagttgattatatggagggaagacagaaatgttgtggcttattttgagatctagcaagaaagtttcaggtctgctcagggaaagaatggcttcatccctaggagctaaactgacctgagaagatgcaggagctagttattatcccttcactgacctcagggtctacagcctaagtttctttcaacagcctgtgggcaagcaactaggacttgcaaaccccagctgctagtcaccagctcggtaggaatgaacatttctgtaggagcttgtgaaacacaccagtaatttgttgttggcttcccagtgtatccgtcactctgtcagctgtcatgtgcctgtgcctccagaatgacagtcactgactcaagttttcagacacatgaggtaaagtcaggaccaaggccgagacactctccaaaggacaggaattgctggggcaggcaggatttgtgctgggaaagtcatagggggaagtgagctcctggacacacatgacaatattgtgacctatctacggcttcacagtgagtgcagcctaggttgaatgtacaaattggttatcaatgccataatcagggcttgattaagagatacaggaatttgccctgtgcttatgagtagcatggggttgtggggagtgtgggaagaatgttttaaaatgtcatgtactcccttcttgccctcacttgctctctcccagctctattggagaggcatagaatgagtaagccattctttcatgagtattaaagtcagggaagacttggatcctctcctggctgggctgttataagcgacatgaacttgggtgaaatcccaaaggttctctgaataattttactcatctgtaagatacaacacgaatgttcaacctctgagtttattactaaacaacaaaatagatgtaaaatacatatcatagtgtctggcattcagaaatctactgtttattattccagggtttgtgatgatgccaggagataccattagaatctgtgctgggaccagtttcctttgagatgtcatgtcaagtatcacaaaggcatgaaagcctaaaaatatgcttccctggccaaatgtcccttcctctctttgttaatgacaaaccagaggaggttgaggttagtggccagggatagcaacatgccatggatgccccatccagcccctgcccagtgcataggtctgccctgatctgaccaaggggagggtgaggaagttaggagggggcatggcatggatgaccagggagggtgaagtgcctatggcacggggtaattcttttgtgggggcggggagagggatcagtgccccaggtgcccattcttctgagtaataatgatgtcatcatgacagccctgttaaaattccctggtggcagttttgatctattgatcatctccatcagattcccaattccgattggggcactttctctaatgatctggccaaaacatccccaggggctagcatggtgactgctaatgtttggaactgccacacattgcttttttttaatttttatttttctaattagaaaagcaatttctttttttattaaaaaatttgcatacctgcttctctctacatctgctaaaatgttaaaggtaattagtatttttttttaaacaaattagaatgtgattggttggagattttatgttgtcgttgttgactgttagggagatgtggagtttcctcaaaatgtcataaagtcagtgtgggtaatcttattaccagggaggcttatgaaggaacgggagagcgagagagaaagatgatgctcagagcaattgtgaggaagctggaaggagctatttagtgcagtgcctggaggggagagacatctcacttcttcctatgtttacaaggggcagctgaatggtgaacaggactttaatcctgtggggcattagtgagccacccacccttctagtattatatccttctgatttcactgcattaggtgggtcctaaagcctgtccctggatctagccccctttttctttctaggacagaagctgcttgaatcctcaggcccagatgctctgaaatggagattatcatttttgcatctcactgcagggggcctcatttttcataaatctcatgtatataaaaggcaccatcccatagttttcttaggcatggatagcaccccttttaatatttctaactccaacagagaccgtaaattggtattctgattgaggtggggatggtgagaagaatgaaggaatgcaagagacttacttttataaatatagaaactaccaccaatccatttggactctttgcagcttctgtgacattcgtatatagctcatggttatagtggatgagctgcacctggcaggagggaaaaacaagaatcagaacaataatccaacattaaaaggtatgaggcatagcacctgcccctacataagggtgaactgcaaagtatattgaggaacaatttggaagacaattttaattgaagggatttcagagggatgtgtgtgcatatgtgtgtaaaatgcatgtacacgcacacaaaaatacccatacatatttgcaaatgttttctggtaacaagcatgcttttcataagctcagagcccatctggctctggctccatcccaggacatttcccctaaagcgtgtgtaaagtgaattttccttattaggaacggaactgccctgtaggggtggatgttgtgtccctgctgcaccaccaacagctgccactggcagccagtaaatcttccttgcagcctcggagcaaacagggagctgttaggtcctgagtcagccatgactgggatgaaactggccagcctgcaagatgcagtagtagctgatggatcaggcttctgatgcaccagcctgtcccggtcatctggttgtgtaggactttatttcctcctcattcaataaggatcagtccacctgttgagcctttttcctgttacttaatttttttaaattcatttttaaaaatcgtgtataaacatacatatatgttcaaacagatgctccagcaatttttagccacatgatcaagttaccccacatcactgggatcaattgtttcctctgaaaaatggatatgatgatctttccttaaaattcatcatctcagggctgtgattttaaaacagttttttcttaacagtatggaagcctaattttttttttttttttaagttggagtctcgctctgtcacccaggctggagtgcagtggcgcgatttcagctcactgcaacctccgcctcccaggttcaagtgattgtcctgcctcagccttccaagtagctaggactacaggcgcatgtcaccacgccaggctaattttttgtatttttagtagagacggggtttcaccatgttacccaggatggtctccatctcctgacctcgtgatccacccgccttggcctcccaaagtgctgggattacaggtgtgagccactgcgcccggccagaagcataattttttaacaaattaaaatatagaagtaaaaaacgtgatgccccccccaccacctctttctaattctagtccatgctatacatacaactattaacagtttagtgtacatccttgtggttacttgttttgtgcttataagtcacacaaacacacatagcgtataaaaaataataaattccctagtccacagtaactgttaaaaaaacagaaagggatgattaataattatgattctgaacttgattttttaaaatttaaaagtagtttgtagctatctttctaagccaatgcatatagatctccccaagtcttccaaataactatagaattctcagttgcacaaacacccataacatatttaaccatcttctcgctggctttcgtgttgtttccatttttttgtctcttataaacaatgtcacagcaagcacatcatatatctttctgtaatggtgttagcattttccacaggctgatttgagaatccaataagatagtgcatgtagaagtgatttgtgactctgaaagtgtaagagagtactcattattgccaatatcttgaattgcattaaaaaaggtgaagttttagaagttgagaaatgtgatgatcaaaaaagatgcttttccttgaactttgagaaaaagaaaccatatctaacccagtggtttgctaccttcactgtgcatccagatcacctgggtgcttttaaagcccacctgtgcctgtctatgccttctcacattctgatttaattgatttgggatgatacttgtattcatcaaaagcttaccagctagagggaagttggacttcagaacaagtggaacataatcaatgaacattaatatcccatcaatgcctagtcagatggacagtaccttgaatctgagaatatcctgagcctcctgaggtgtagaggaacttctcatgaagagagcacatgttactgctgctcttgaaatatcctatttgcttattgctttttcacctatgagttttgccagtggagatggatgactctatagtagctactctgccatcagaaaggcaaccgcaggccaggcgttgctctgcctccgcaggacttttaatcccccctcccttgtacccccacacaaccaggactttctgcaggtggagaaatgttgccaggtggtggaagaaccagggactggggggttctcacacactcagcacacctcccttccagtgctgagtaagcttctaatgagaacaaaacacaccctgccatctgctaacttcttcccactgatacaggtgaccaacaaaactgccaggggatgtgccagtgcttccagacatgccttgaagttaaagcatgttctgaacagaggagggacatgaaaggcaatccagtggagtgatccttctgtccagcttgcaaggcagaaaaaggcaggaagaagtctcctgggccatgggctgcctctcagggtggggttcttttgggagccaggaactgtaagaaaggagctggcaagtacagggctgaggctgtgctttaagcttgagttaacacatttaaaactttgatctgaagtcatgcctcctctctgttccaaggtgagttggctaggattctgatatcaggagctttggtttctattagtagttgttgatggactgtctattgtgttaggttgaaccacatgaaattgatcttttgctttacaaaactggtgaatttatagttaatacattctagaaataaagctattttgaatatgagttttgagcattttctttctgacccccagtcagatgttaataagatgacagtgtgcgctctagggatcagcagcagccacagcatctaggagcttgttagaaatgcagaatcgggagccccatcccaggtctcctgaatcaagatctgcattttctcaaattcctagtgatttggatgcacgctaaagtttcagaagtgctgctatagcagatactgttggctggtgagcagagtcctgttttgtctggctgtttaccccttctccacttcaatttgggtgggttaaggagcacatgcatcacctatgttggaaaacaggctgagtccagatcataggacccctggaatgtcagcaatagaaaggctttgagcaggggaatgagataatcagcatggactgtaagagggtagattggagccaggagaaaatagaggtggaggttggggggtatttaatttcagatgatggttattaaggcagagatgtgctctataggcctttgcagtttacagaatgtgtatgtttgtgtgctgaagaggcaccaggagatttccccaggcaacagaacatctaggagcaacagaagagcacaggagacagcttgacagtcaccaggctttttgttctcagctgtaagaacacagtttgggcatcaaagataacctgggacctgtatcagttcatgcatgaacagcaggtcttaaccatgaaaaagtgctgcttcctttctactgccttccaggtctttgttggtggtgatcacagttcctgcagctgttgcctttgctcttccctagccaggcacaataatgctaacccaatacccactaaccactcacaatatgcatgggtccaggtgggtctggagaaaagcagggttcactgcttctcctaccatgactttgggcttggggagcagcaatgtgcaaaccacatcctgctagggacagagtatcagattggcagatgggttctgaaagtgatgcctgtggatggatttctttttgccatgtataggtaacacttttaaatctcaaccatataaagtctgaattttgaataatttagatgggccctaagctataccttaactgagccccaactttaaggcttatgcagagtaatcacagtgtctgatgtgaaacagatgatcaataagtgattgttcaactgtctgagcaagtgcatgatttgactaagactgcagggacaatgagagcaaactcttcgggggctaatgatgacatgctaattaaacaccaagttcaagttcaagaatttaagctattcattaaagagatgccttgagggcttctgctagtttagttggcattaccatgtgaaagggttaaacctggattcctggaaattatttaataatcttgattttttaaattagttttaggcgagtatcctcctagagaagcttcctggaaatgcaagactgagaaatggcaggcagtcttccagggagaatactaccagtcttgtcatgatgctcccacatggctggtgccatgatgcagtgcattctctatatctaagaagtcctccatgatctgatgtgacttgacttctcatttcagaaaggccacctcacctcaatcctttacatgggcctggaattcatttgttcaaaaaatctttgagggccaactatgtgctgaggtcaattggaataagactgagaaggtctttgtcctcctagagatagtttcagatggtggcaaagatagctttgaaggaaacaaaacaagattttgacttacttacagattgaaaggtagtagtggaaagaatgggggcgaggatgcagaagtgggggcaacattctgtagtatggttggtgaaaagtctttgggtaggctaacatttgagctgaatcctgatgaccaggagccaggtatgggaagatcagagggaagcatatcacttgtagagaacacggccaatgcaaagagcctgagatagggacaagcggctaggaatggctgggaaaggatgaaggtggctcaagatgggaccagttcatgcaaggctttgtagaccatggtgaggagctttgattttattccaaacacaataggaagtcacaggtgttaaataagaaaccaattgatctgatgtgcatttttgaaagatctctctggtgtggaggagggcaaagtggggactgaggaagccttgcctacccttctttacctcatagttcagctgggattgtgcccaattcctgcgactatttgagttcacattcaagcacatgctattttgcaactattctctttgtgtcttaccttctccaggacaccttccatgaaacactgtctctgaacaccaagtgcagctcccttctgctctcatgatgctctcacccaggaggcaaatttgtgatggttaattttatatggcaacttgactgggcaaagggatgcccagacagcaggaaaaacattatttctgggtgtgcctgtgagggtgcttctagaagatattagcatttgaatcagtaggctgagtaaagaagatctggccttatcagcgagggtgggcaacatccaatctattgcaggtatgaatagaataaaaaggtggaggattctctcttccttcagctggggcatccctctttctttgcccctggacatcagagctcctggttcttgggccttcagattttagactctgggacttacactagcgaccacctctctccctgtggtttgggattggggattacaccatcagcacctcctggttctccagcttgcagactgcacattgtgggacttcttggcttccataattgtgagccaattcccacaataaatctcctcttatatatctatgtatatagcctactgattctgtttgtctggagaaccctgactaatcaaaattcaaaatactttgcaaccaaaatgggatgggtaccgggtgatcagaacagatgtaaaccatagacgcccagtacagtcacatgagtgctgaatatcattgttaaagttagtcatcatcaccactttggatgatcattaccaacatttgtcgaacacctctttgtgtgagagacgatgccagcagaaacaactcatttaattcttgaaaacttctatgagttagtgccattatttccatttgagtcatggggacaccaagcctctgagagatagtggcagaggtgggattgtgcccagttcctgtgactatttgagttcatactcaagcacatgctattttgaaactattctctttgagtctgtgtctacttttgggtaaacatctcaagggcatggatatccatcatcacatccctggtgatgggatttggctcagaggagatgttggcaagcatttgctgaatgaataccaattctgcatctcatagaatcttagaaggggtcttagagaaaatcaaggtcttagttctcagcccatgacttttaaaaatgaagaaaatgaggatcaaagaggagctatgtcttgcccatgattatacagtcattcatagatccaatcattcaacatgtgtttattgaacaactcctaagtaagggagggtgatatgacgagaaattgtattggaaggcaggagaagaccatggagagcttggcaggccaaggtagggggtcttgattccatcctaagggtaacgaagaatttcacttatgtcctagaattttcttaggaccagaggcaaagtttctcctatgcacttaattgaagtggaagcctgaaaaccattggcctttggtgaccggtaactcagctttcaagctaacagacaagtactcctctgtgttaaataagcagacctgctgcaagaggcttccaagttgacacaagccacacttgtcataggttaagctgggagcagcttcagttgcacaggtctcagagttttcattttgtggtagcaaggtgatgcactagtgcatgccgggggctgctcactcacccctcatgcctcaggagggcaacaggctgtgttctcagaccttagatcacctttctcagcgtgatgctccattagcagaagcccttttgtgagcgcaaaagagcagccttggaacagaagaccacacgtggcgttcacagtgacaatgctatcaccttacccctgcttaaacacctcagtggcttccccttgcctgtaacataaagatgcacatctggggcccctggcttttctaaccatgtgtccttgttttctgtgctctgctcagtgtctttctttcagcctcccttatatactgggcttcctcctttcctagaacacatgcttattctgtttcttatgcttcccttcccttaaacagagaagggagggaataaacttccctcccttcactgtttgactcctacttatgaactcctttgtatctcagctcaagggtcacctgttgagggagatccccatgatccactgtcatggcactctgtacttttcaaaatacatatcacagttttagcttgacattcgttgtgtgactgatgaatgctcacctctttccctagactgactttaggcttcatccaggcatgggctctatcttattggcccctgtgacatctcctatacctggtacatattaactgtatcaaggcagaaataaataattgttaatgaatgaagcaatgcaggctgtctattgtacaatgaagtgtgatgtcccaagggacagagagaacaaggcgcttggctgaactggttaaagaacagtctggaattccaaaggttatctctaatgggaaccaagacactgagtatcacattgggctgcgtgggttgcaaagcctggtttcacccttgggtccccttacatgagcaagtctctcatctataagagggatagtaataattcataactaatactcatagcactgtgtgatgattctataaaaccgaatataaaaaagcacttagcccaaggcctggcatgcagtaaccattccatagtaagctactattgttgttgttatgcaatatttattatgcaagcaatagataatacagccttcagcttctgcagaaataggggttaggtatgtgcaggtctcctttgtggatccgacattgagtctgttctcccaaggaaacttgaggaaggtgtcacctattggggagcacccactgtgttccagacactgaatgaggcgagaacttttaaagagaaatgcattccgaatggctcatactgtaattcaggggtcagcagactttttcctgtaaagattcagatagtaaatatatttttctatgccaactgtatagtacctgtcacaactactcaattctgcttttataatatgaaagcagtcatggacaaaatataaaagaatgggcgtggctgggttccagtaaagctacagaaacacagcgtaggctagatttggtctgtgactgtagttttctgaccgctgctagtttaaatttgggagatgaataaagaacttccagtcatatattttccagtaagtgttctatacagataggaaaatacatgttgagagaacctaagcattaagctctccctttcctttaaatgatgatgattactattgttacctttatatagtcctttaaacttttcaaggcatattcaactcaaatgagctgaattctagtcaacgtataggtcccaaatgcccaccctatgccagatcccagaagtccagagatgaatgctgtatattccatagcctaaaacagctcacccatattaccacatttgttcctaaaataaataggtgaagtgaagacattaaggcacagagaggttaagcacctcttctgaggtcacacagacaaaaagtgacagtgactattcatttcacattagcatatgcaaatagtttctttctacaggaaagtaaagagaaaaggaaaggtgttctgtatttgaggggagatcacatttcagcagcttttgctggaacaactataagctagaacttatttatagaaagtcattaacaagtttgtcttcatgcataagagcacacacagtctgcagagaagaacacagtttgatgtttaccagccaccacattctcaccctaaggtttggtaactatcatgggtctgtccggtgatgagattttctgcattgtaggctatggaatgcaattatggctaaaaataaaaataattttccatagtttcattgacagaagatccccaaatgtggtctggctatcataccaacctagaaaaccagcatggaatgtaattattttcccccaaaagataacacaacttggattttaaagcatgtttttcatcaagttgtatgggagtttgcacaaatgtagagtgatatatttgggtgcaggatcatgctggaaaatgcaagaccttgagcctagtcagatacctcttctgtccaagtaatgtggggctacttatcccctctgattatttctttatgcataatatagggatgcatctatctaagaattgtcatgagagtgaaacaagataatgacacagtctttcaggaacttggcagggtataagtaaacaagataaacagatgagataaaacacataaagaatcagggaagttccgtgatgctttttttttttcccggaacttggaatgcgtttcgagaccactttttctcgattccttccccaggccttcgcatccttcaacttcttataaaggagctgctgaaagccagagtgggatgagcctcctgcacgacgtctagatcctcccagaagtgacttgtaggcagtggctgccaccatccaagaatgagagatgaggtctgcaggtccttttgaaacttctgctgattttagttaagcctatttcttccccatgctcctgcaacctcaaactcatcccaacacagggcatggatgaggagagttaggctctggctccaagtcctgggtcttctggtcttctttgaacttcaatttcttcacaggcaaaactgtgatgacaacataaccactcaaataatcgtgctgattaaatgaaccaaaacatgtaaatgagctcaggtgtacatgggataaaggaggcttcaaatgcagtgcctggcacaaagtaagccctcattaaatgggagttgcagtgattattattagaaatgtctggctgctggggctctgataaagggagaggccctagaatgatgaagtgacgtgttaagttccatagataacaacaaagtcaggccattcacactttgggactgtatttcttgacagtccatatatcattcacatttgcatcttactttatcttattgtcagatgactaccaagaagattttgccagtcttttctttctgtagctcgtattcttgtattatgaaaatagatatactgaacatgtctcataccaaataccttttctcttttaggattgttgctatttctgtggaagagtttgtcccatgagaaccactgtactggtatgtgtagggcatttttgttaaatattaagtcattccagagcccacataaatagtattaataaaggctcgctttgttttaattattgtagagatttaatgttatgtagttcatttgagttaaggcaagaattatttttggtcatctcctacgcaaaaaaaagcgttggtctagatgggtttataagtatattccagcagatatttgaggggaaaataggccaatatcttttacgatcatatatgcaaaaagccaaaattaatactagctagtggaaaacagcattaaaaataatttattacaatcaagtagggctcatatcaggagttaagggtaaatcaatgctggagaaatcttccaatgtgatctagcacatcaattgaatgaagcagaaaaaaagggacatgaacatctcaatatggagtacctgtatttagatagagctaaccaaattaacatccattttagtggaattacttctcacttaaatggatgaagtatacaaaaaaaaaaaaaaaatagaatctaatgcttcaacctgatgcctgggatgtcttttgcctgaggtctgagctctggagtgaacaaggaagacagcttctagatgatcatgagacaattcaggccaaagcatgtctctgtgatgctgagaaaggctctgaaagcttcagcaatgtggtgtccagagggcaatgtgattgaatgatatttcgggagaccacaatgcgaagttttatcctcttatagttattcataaaagtttatagcttcactggtatagatataactaaattggagaggaatgtgatttttcaaatatccaggggcaatgactctcagtacctgcagtagatgcacaccaaggggttgacggagaagacttttctagctcacttcacagttagtccccatcctggaggaaggaaagactgaatcctcacacactgcttgccaaagccatcttattcactcagggttaattcagaagagtcactttaggtggctactgtcctaactgatatattcatggaaaattagacacataacatctattagataacagaggagggttttctctcctctcataaatgaagctgcgcagcgatttggataaactgttcacaaaactaggcttggttttgtacacattaattgcataaagtatgatacttaataagcagaaacacacactggtttatttcaaagccattaaacccgcagtggattgactgtaggggatgaatattagaaagagcacagggctgggagtcaaaggggctgagtttgaatgacagctctgtcattcagtaggtaggtgtgctcggtgagtcactgctcccttttagacctcagggtctttatctggaaaacatggagattttaaggacagggttttgtcattcttctaaaacactgatgggaaatataggatgttgcctcttgagtttccatcaaagtcaattaagttatagtcacatgttgcttaaaaaccaggatgcattctgagaaatgtgttattaggtgattttgtcattgtgtgaacatcatagagtgtacttatataaacccagatggtatatggtatagcctattgctcctaggctacaaatctgcacagcatgttaccgtactgaataccataggcaattgtattgcacacagtggtaagtatttgtgtatctaaacgtagaaaaggctcaatcaaaatacgatattgtagtcttaggggaccactgtcacataggcagcctgtcattgaaggaaatcttgttaggtggtatgtgactgtatgtagaattgaaaccaaatatttaaaccaaagtttcagtaggcagcatgtttatgcctggggttgcaaatggatgactatgggaccaggctgcttgtctcaacagaggagaaggctaggcaaaggccatggccaaaaaatatgaatgtgcagcttagtcccagggtctcctggcagccactttgtgactcctggtttcttcatttgatcgtgcttaggtcaaatcaaaccaaatccaaacaaaacaaaatatctcaaaccttcactcattgattcttccaacaaacccgtatgtgtttcccatgtgccaggcactgtgctgggcatgaggagatgaaaagagggaagaccttagaggcagtaggaggcacatatgcaagtgtcctgtagcatcatggaagaccatgtgtaagaggaagaggctggagcccagaagggaaggggaatgaggtaggctgacccaggagaaaaaggtaaggacagaccacattcatgcttggagaccctggtaagaatattgtctatcctcagaacagtggaaagtcatccaaagtttgaagatggagaagggggttgtacgtgcaggggtagggaatgttgatgacagcaggtttgtttctgacactcgattgaaaactctagagggaagtgaccctttactgtagcgccttttctcaatgtggtgtctgattcttccagaaatcacattaccaactgcctgccaactttcccctattcctgcccttccagagcctgcccaggttcttggtgagccaggtattcctaatcctggaatcatatcactcaaatttaataacctctctcatgtgccagtacttgacaagttaaaagtaatttgaatatctgagtattaatattttaactatacaaggcaccacaaattatttagtgattttttaaaataaaaaagcaaataagaaaatgatgtatcaattcagattgcagggaataggagatcccaacacaggcttctgaaaaattgggaaaagcacccaagaagattataaaagatgactaatgagcacaaaacaacttttggcaagcacaggaaagtattagcttattccaagaaacaagacacatttcatccaattattggaaaataaatggcaagaaaaaccaaataccaagaaagtacccacatttatgtggaaaagtataaaagcaatgattcaggaactaatttgaacaatccagggatagtcatattgattccagcccattgctgcaatttgaaatgaagccaaatgccagaggacaatgagatctgttttatgggctcttacatgccacataggagggagggagccacaggaatgcaccacattgaaaaaggaattgtgacttctgatgggagggcttttgggccaagttaaatctcagaatccagctctccccctgctccccagacagtgttgctagaggtcaatggacagtggggtctgagcaagtcttcattgtgtgtgattgccccttgcttgcagggcctttagaacctttgcaccactcccactaactgcttgcagtacttccatcatgatgtcaatcccaaatacctcctacccagtttaaaacagcccttgtggtatatatgtgtgtgtactgcccagatggagggctgtggctaggaaagtcagtttccctatccgtaaattggaagaatgattgatagctccttgtgctacatatttctgctgagcaagcaaaaaaaaaaaaaatgaccttgggttagaacatccttcctgctgcactctgtgtggtcattgaatgtcacttctgtgcaggatgcagctgattcttttctctcctagtggattttgttttacagagggatctttggtcctgtgactgaaaggtgagttgggggtgacagtggggaaaggagacagaaggagggagagccaaattactctcactgtactgcagggaagtccagatggtgcccttgtcctaagcttccaaaatatgctctgggagggaaacagagacagcattttgctgacagcacttgggaacaggcgtgtgggcactctatattaagacttcaatatccattccaagtgtatctgtgtgtatgtgagagcactgtggctttacttggaaaccaccggtcccaatctctctggggcagattccatttttcattctttcctccctatccttgtaacccaggcccaaccattcagcaaagggtctacccccaaataccatggctccctctggggcctctgtcttttgccagggcaaaggttgtttccagtagaactgggtcagctagagggaaaggtctttatcccttgggtagccggagtctgaggcattcccaagggcgagtgggtacagtgtggttcccatccacagagtggtggcatgcatgccatgccagctactgtaccagggaggggcgatttcaagaagagactcagtcttggcctcaagcatttctcagtccagagagagagagagaaacccagctcttgcaggcagagctttataaattacaatgcatcttcctgcccacttcctttctgaacccaaacaatagcccttctgtgaattaggccaggatgctttgaaactgtctttcagacaggaggagctgaggacccaaagtcactcggttgtttatcaacagatctagacttaaattcaggtctctgattctcaaacacagtctaatttcgatctgtagacttggtcaagctgctgttttgtccggtgtactgtcctgatattgagaggtgacaatgtgctagcaacccttgctcgctctcgggacctcctcggcctctgcatccactctggccacacttgaggagcccttcagcccgctgctgcactgtgggagcccctctctgggctggctgaggccagagccagctccctctgcttgtggggaggggtggagagagaggcgcaggtgtgaaccagggctgtgcctgcactcgtgggccagcgcgagttctgggtgggcgtgggctcagcgcgcccacacttggagcggccggccggcatcacaggccctgggcagtgaggggcttagcacctgggccagcagctgtggagggggcgccaggtcccccagcactgctggcctgcctgcaccaagctcgaattctcgctgggcctcagccacttccctgtggggcagggctggggacctgcagcttgccatgcccaagaccctgcaacctcatccccgccgtgggctcccgcatggccttgtggtgcccggtcccatcaactgcccaagggctgaggagtgcaggcgcgggaccagatggcagctctgccgggcggcccagtgtgggatccactaggcaaagccagctgggctcctgagtcgggtggggacttggagaacttttatgtctagctggaggattgtatatgtaccaatcagcactctgtgtctagcttggggtttgtggatgcaccaatcagtgctcagtgtctagctaatctagtggggacttggagaacttttgtgtccagctaaaggattgtaaatgcaccaatcagcactctgtcaaaacggaccaatcagcaggatgtgggtggggtcagataagggaatagaagcaggccgccccagccagcagtggcaaccctctcgggtccccttccacactgtggaagctttgttctttcgctcttcgtactaaatcttgctgctgctcactctttgggtccatgccacttttatgagctgtaacactcaccgcgaaggtctgcagcttcactcctgaagccagcgagaccatgaacccaccaggagggatgaacaactccagatgcaccacctttaagaactgtaacactcactgcaaaggcctgcagcttcactcctgaagccagtaagaccacgaacccaccagaaggaagaaactctggacaccccatctttgaaaactgtaacactcaccgtgagggtctgtggcttcattcttgaagtcagcaagaccaagaacccgccaattttggacacaatatggtttggctgtgtccccacccaaatcttatcttgaattttagctcccataattcccacatgtgggaggaacctggtgggagataattgaatcacagggtggtttcccccatactgttctcatggtagtgaataagtctcatgagttctgatggttttatcaggggaaacccctttcacttggttctcatgccagctgccatgtaagatgttccctttgctcttctttcatcttccaccatgattgtgaggctcccctagccacgtggaactgcgagtcaattaaacctcttttctttataaattacccagtctcagcagcatgaaaatggacccttgcctgaccttcaatttaaaagaattatagtagctaccatttaaggagagtttcccatgtgccagcagggtcctcaatgccctacagaggtcatctcattcagttcttacaacaggtgtacaggcagggattactgtccccatttaccagatggggaaactgaagtgggggaggtgaaataacttgcttgaattcactcagtcagtaaaaggcagagccacatgttagacctggtttgtgggctttctcaccaaggattgtggggagcttccctgattgattgggtccgcattccttttttttttttccccctggaatctctgggacaccaactcatgcgtgaatctggggaattaatcttctcttgttgggccctggctgaggggttcagtgatccctgagctccattccagctctttctctggatttatctgtagcatccatacttccccaagtttccaggtgcttgtctcttatatccacaatgagtaacaccaccactagtgaattctagtgaacattattgggctataatgtgagccagggctgtgttagcctgttctgatgcattatctcatttgatccttgcaaaaatcgacgtatgagaaccttatcacctccaatttagagttaaggaaactgagccttagagatgctaagtaatgtatccaggtcacacagtttttaatagaacaagagcttgtgtctgatgccaaaaacaaaatgttaagcactaagttatctggcctctaatagacggaagtgctctgggacttgggattgtcaatcagacttagggggtggctaaataaatgaacccctgtggaatgaagtccccttgcactcctatagttagtgttttacttcatgtcagctgtggagaaataggcacagctggcttggtgtatctgtcagctgttaagtctcaggttctgtcttctaggtaggagctaccccaggcacagcactaaccctttcctgcaggttctgattgggggccggcctttggctcttcccggctgctaatgctatctccttcccaccttcaaggctccctgccctgagctgtccctcagggttctccatagtccaatcctgacttttccagccttctctcacctcctcctttacaacatacacctactgctgaaggggctttttgatgccccctgaacatgactcacagtttcacacatttgggtcattttttttgtttttgtttttgtttttgagatggaatctcgctctgttgcccaggctggagtgcagtggtgcgatcttggctcactgcaagctccacctcccgggttcacgccgttctcctgcctcagcctcctgagtagctgggactataggtgcccgccaccacgcctggctaattttttgtatttttagtaaagacgtgatttcaccgtgttagccaggatggtgtcgatctcctgacttcatgatccgcctgcctcggcctccaaaagtgctgggattacaggcatgagccaccacgcccggccacatttgggtctttatccatgcggtttgtctctaccaggaatggccattgttttggctgtaatttctgttagtggaacgcccctcctaaattgctatctcctccatgctggccttctggattttcctgtatgaatttgctgtcttcctccttttgaaatcttgtaacattaaagtaacattaaaatatgggcttgactgtgctttcaatgatagcttctctgcttgtagcagttcctccatagcctgtaagtagtaagaagagttacaaatctaaccctagccttgccacttcataactgtgacttagggcattgagttaacctgtctgaacttcatctttagggtagagataatactgtttatttccccagttgttgtaagaattacataagttagtgcatgtaaaacacctagtatccaccagacatgcaataggcactcaagaatcttaagttacccatattcccacatttcttattacctcttcccccaaatacacacagatcgtcacacacaaacaatactactgctgctaccaccaccacgatgatggctcaatgcccagtgtgtacaggatcacagcatgctagcgctataaagttccctagcagcccatggttttagtcactgttttgcaaacgagtaactagcacctgggttgggatcagctgccctaagtgagtacagtattgcagctaacatttactgggtacaacaccaaggcattgtacttggtgttttataagcattatcttatttgagcctcccaatgaatcccctgtggggttaggtaataacattttcatcacccctattttgcagagtggtggggggccgggggaccaaaacttagaggttaagtagtttacccaatatctcacttttctaataagttgaagagctagaatttggaccccaggagcccaatatcagatcctggctcttaaccagaagccagaatgaaagtgaactccagatagcctgcattattttaagagtcctctccagtgtctcagaaagggcttcagaaattcagaaaaagctcatttcttgattcccatgccagggctatctgcccaggggagctgaattgaacataaatgaattctaccagcccagatccctcaccctgccagtctcagtcttctcccggaaaagttaaaatgagttccctgagctctggctgctttctagtggggagggagttccagtggctttgcaggaggggagacttggaagaactccaccaacttagtttattccaaggcatgcccaagaaatggattttcttgactctgtcttggctgagacaaaacacacacctctcttgttggtctttctgagttgaacagtcttgtggccttaatgcctatcacattggatggtttcaggaaagggccattctttgctttcttggtccatgaattcagagctgggttgagcagtgatgagaaaatgaaccccctagccccagccagccctggatcctctcttgagttcattctcctttggcatttggtaagcaggaaccttgatgtcccagatggtagagccaagggatggccccaggcaattcatgcagatacctcagctggttgtagtgaatcattgtgtctatgcaagaaggacttatgagcactcagtgggaattctgtacttcaaatagcctattccaagtcaagctcattatcctgccaccctgaactctactccaaatctcctcctcttccttcatcccctctaacatggccatcatcctcccagtgctatatttatagacttgggcgcctactgagactcttttgtcttccttattcatgagagctcattagtcatgaagttctgtgaatttttgtaatacacttcatggttcttgcaactattgctgtcctctttatacccagtgctactgcttcagatcagggcctcaagtactctcaccttattattgcatcacttcctaactggtcttgctgcttccaaccttatgtctctcgaagccagtctctccatagccattgtgatggctctaggtctaaacatttcacttccctgcaaacgaaatccttcagtggcaccttagttccctatgggaaatgtccaggctcttttatccggcctgaaaggcccaccatgacctccagcttcaccattcacctccctgcccagcccacataagccggccatgccaagccactgcatggacctgactgtttgcacatctgtatctgtaaacacaccttcccctcctcctagaatgtccttcccccccaggttcatctggaaaactcttactcatccttcaaaaccctgctcaggcttcaccctccaggtagagatgctcatgcatgcctctctgctaccatcatgcccacaacatacctctattaaggcctctactgcttcatattgcaatgatttgtgtacagcgcatctcccaggtaaaatgagagctgcttgagggccagacagtggtttatagaaattatttccccaggacctagcacagcttctgacacaccataagcactaaatatactttgttgatatagatgatttttctgaattgatccaactgattcctttcacaagcacaaccactgcagggaagaaaaatagtcttcttacttaggaaaaaaattacttgacatgtcttaactgtaaaacccttgaacaagcactttatccttcttctgtggttactttttcttttttattgtgtcgctgtggtctggataaagttgtctgagttttattcatttcttaactctgattgctatcttgcaagggggatgggatgaaatagcaaacaatatattctagcttttttctttcccagaggcatatatagaacagcctctgaagaagtattaatattggaaaagatgctattatctgcattatactaattaatccatacatctacctgtcattctttcttttctatggcttttctcaccgcagtggtgtgctcttccgctgctggtaaattggcacaataaatctggggggaccacctctatttccagcagttcacttaacattttatcacgtggccgtggactcaggattgaagtcagttaaaaagattaataccatttaataccacccagaaggaagatgccagaagtctgtttaaggtcctgttattcatgtcttcatttcctttgtgcgtgtattgtgataagcatagccatcctttttaggctgctgctaataactacttaaaatgattaaggtaactagttatttcctgtaagaaaattgcgctgctgtcattaacacgaaattaacatggctcccatttcatcttcagcacacagcctgttgccccccgttgccttaaacaaacagaactgtctccagaaggctgtgcgctcctttgtaagaggcaaggaggtaagaaagcgtagttttgcagaggatgctgcccatggaggcagccggaggagggaaaagcatagtcccccaaactgccatgaggtttggaggagtaattagcataattgtcattattctgtatggcctgagcaatgtgaatgggatccgtgccctttaaaattcccagttctcagtcgggcatggtggctcatgcctataatcctagcactttgggaggccaaggcgggtggatcacctgaggtcaggagtttgagaccagcctggccaatatggcaaaaccccatctctactaaaaatacaaaaattagctgggcatggtgctgggtgcctgtagtcccagctactcaggggagaatggcttgaacccaggaggcagaggttgcagtgagctgagattgcgccaccgcactccagcctgggtgacagagtaagactccatctcaaaaaaaaaaaaaaaaaattagccaggtgtggtggcaggcacctgtaatcccagctactcaggagactgaggcaggagaattgcttgaaccctgggggcggaggttgcagtgagcctagattgcgccactgtactccagcctgggcgaaagagcaaggctgcgtctcaaaaaaaaaaacaaaaacaaaaaacacacaacaactcccaattctctcaatcagtagttctcttaggttggtgcaaaagtacttgtggtttttgccattagttttaagttttaagaacaaggaccgcaattacttttgtacccaacgaataagattttctcttacttgacacatgcaagacatttgcatgtgagagacactcccatcggaacactctgcttttgagaaggatctacacatatcttgtagggacatgaagcaccgtgatgcttgtaaggtcctaagtattaatggtaagtcagcaatggctgcttattgggagtcttggcacaaataagattggctagtgctacttaagtggagtctgtgaacatgtgtgtacaagttttagtttgagtacgtgttttcagttattttgggtatatacctatgaccggcattgctggactctgtacttttatgttcaactttttgaggaaccaccaaactgttttcctatattttaaagttgagcacttatgtgtgccaggccccgagttgaagagttcacgagatagtgtacttggagggtgaacatctagagccaggaggagaccagagggccaaagtagttcaagtcatctttgggaatctgtcacagttgtccctcttgctcacttgctcttactcctctaccccactctgattgtctgctgtgagtggcaccatcagcacagccatcacctgagagcatattagacatgcagaatctggggccccacccagacctactgcaccagcatttctgggggtgaggcccaggaatctgtttttaagaagccctctaggtgtttctgatgattactcaagactgagaagctccgagatagatgtaggtgcagtgttacccttgttgctcttacatcagaaaccctattggctgcaaagtgagcgtcagatactgcttttagagatagcttttagtcttctctaacttaaatacagtgaatcatatgcaacactccccacttttagcaggttatgtgcacccacttcacttacaactgcaaaaccctaccattccaggcagagtcacctcggttccatatcatgtcaggggctcttaacttgtcacagtagaaataacccagggttatcttagtaatcctgagactgtgctcttctttaccacccaggccagcctgcaaatgtgatgatgggtctaccacagagtccatggccacagagtagccctctgtggcttcctgacagccaagagcagcctcgatttgatatctggtgtttgttttaagcctttcctttttctgctgtcaggaagtggtaatgtagtagtgtgttgaaagagcatacattttgttgtcaaacagaccagggtttgaattctgattctgctacttgagcctgcaaaatgggttaataatatctactatgtggaataatatttgttcaataaatggtggtgatatggtttgggtctgtgtccccacccaaatctcatgttcaattgtaatactcagcgttggaggtgaggcctggtgggaggttactggatcatgtgggcggagttctcatgaatggtttagcaccatccactgtgggccgttcttgtgatagtgagtgagttatcatgagatgtggttgtttaaaagtgtgtagtacctcctcccttgtgctcttcctcctgctccagccatatgaagaggcacctgctcctgccatcattgtaagtttcctgaggcccccccagaagcagatgctgccatgcttcctgtacagcctgcagaaccatgaaccaatgaaacctcttttcttataatgtacccagtctcaggcatttctttatagcaatgcgagaatgaactaatagaagtggttactgctgttattaatcattgctgataattaaaaaaaaccaaatatgtacataaaaagagggagacagggtggagtagagagagagagagaactgtcataaattcctaaagactttttgaactactgtggccctctgtctcctcttggctctagatgtttgtcatccaagtgaactattttgtgaactcttcaactcagtgcttggtacggggtaagcactcaaaacaatttggtacctcaaaaagttaaacatacaattaccatataacccaacaatgccactcctaggtatacacccccccccccaccggctgccaattgaaaataggtacccaaactgaaaactgtacacccatgttcacagcagcactattcacaataccaaaaggtagaaacaacccaaatgtccatcaatgaatgaatgggcaatttgtggtatacccacaaaatggaatattatcctgccatgaaaaggaagaaatgacaatacatgctacaatgtggatgaaccttggaaacatgctatgtgaaagaaagcagaccaaaaactcacatattgtataataatatgtaaaatctagaacaggtaaatccatagagacaggttgccagaagctggggaagggagaaatgggagtgactttaatagataatggggtttccttttggaatggtgaaagtgttttggaactagataaatgtggttgcataacattttgactgtgctaagtgccattaaattgttcactttaaaatggttacttttatactgttaaaattaattaaaaatatatatgtatatatgtttatagaacaataaaggatgaaaggctgagcctgaataactgatttacttattcggaaaagcaaagccgtttaaaaaatattttacttctgttgcttctggctataactgaaaatccctcagtccatgtggggaacacagatgacgaatacgcagccctccagcatgtgtatgtggtcattaacttggccttgctggtccagggatttcaggtaaaaatcaggaactatgaaagttattaataactcagttgcttctaagacaggtgaacatctaagacagggccataggaatggtgtaatgcagtcaagagaaaaatgtgaaggagaaggatgcaggcaagttctcctgagagacagatccaggagcataaaattggcattttttctccattaaacaatttgggatgatctgaagtctcctccaagtttctgtctctctctttatcttaattagcaaagaaagtcttaggtacagtaagccctctccttccctaatggattagccagcaaataggaaactaagctttgggagagactaataatagaatgaagggaaagaaggacaaggattgactgtagacttaagctttctccgttcattcattccttcatgttccaaagcaattgcatttcttatttgtatgctacagtcattctccaccctcaaagagtttaccatttattggtgggggtgggggacatggacacaaacaagtatacagtaaaccacagcatcatatgtcagactgtactgtgcatatgaatcctttggcaatcttgttaaaatgcagattctgattcattatgtctggggcagattctgattcattatgtctggggcagggtctgagactgtttttctttctctttttttttttttgggatggagtctcgctctgtcacccaggctggagtgcagtggcgtgatctctgctcactgcaagctccgcctcccgggttcacaccattctcctgcctcagcctccctagtagctgggactacaagtgcccaccaccacgcccagctaattccttttttatttttagtagagatggggtttcaccgtgttagccaggatggtcttgatctcctgacctcgtgatctgcccgccttggcctcccaaagtgctgggattacaggcatgagccaccgtgcctggcctattttttttttttttttaagacagagtcttgctttgtcaccaggctggagtgcagtggcgcaatctcagctcactgcaacctccaacccctgggttgaagcgattctcctgcctcagcctcccaaatggagactccgtatttctaagagcacagaggtgaagcctgtgttcctggtctgaggggctagagtgtgataaccacaataaaaaggagatgccgtacagcagattcagcaaacagcctgcaggccatatcctatttttgtatggcccatgaactaaggatggttatacatttttaaatggttgggaaaaaactcaaaccaaaacaattgaagaaggctgtttcacgacaactgaaaattatataaaattcaactttcagcatctgtaaacaatgtttcattggaacagtcacccctatttgtttgcatattgtctgtgactgctttcccactacaaaggcagagttgagtagttgcaactgagaccatatggcccacgaagcctaacatgtttactatctggcccttcactggaaaaaaaaattgtctatccctggtataaagtaatatgggatttcaagagagagggaaagatcatttccagttgtattcatcagggaagacttcatggaggaagagtatatgagtagcttgaccagtgagtaggatctgagtggcagccgttggggaggaaggaaatctagtaaatgcataggcttggaaataaggaaagcaggtggcatgactacagatctcagtgtcgaaagccttaagccaggttgctgtccagactgccagcttccttctgaatgggaaagagaaatgctctgacacaaagaaactctggttcccagctctggaagattaaaccaattgggcaagtgtatggtggactacatgtgtatccgtgagcaataatgaaggccaggtataacagtggatttctgggtgagcatttggaagccagtggttctcaaagttggggagtgacactcccgcaccctgttccccagggagtgtttggaaacatctcttttgggttgtcatactaattaggggacatctcctgatacttactccccaggagtcaagaatgctaaaggatttacagtgggatgcagaagactatagttctgggcaaggtcacatgtcctcccctgaatgtcaacagcaccctcaataacatgctcagtctgaggactcttctgtggtgtagaatgaccataggttgagaaattaaaagacttggatgaagggaatggaacccacttggatagtgatgaatggagaccaagcaagagggcagattgatgctattgcttggcagtgagaccaaaagacttccatttcccccccaacattcccagagagccagaatgccagggtagagtacaaatccaaagagaatctatattgtagggaatatttatggtgcctatgaaagataagatttgcatgatgggtgaaggtcaatgacaattatttattcacaaccagtcttccagccttaatctgcacagtggttaggtggctagctttgcaatcagaaagagctgggtatgatttcagctttgtctcttcctagctgggaaacctggataagttattttaaattttcttgttttctgatctgcaaaatgggtatggtaatagattgttttaagtattgattgagataatccgtggggcaggcttagcacaatattggggccctcaggggtgccctgtaaatgagtttccatctctctttgcttcaatgaacacgaactgattttctgatgccatcagtgctgctgttggcatcagaatagcaggtgggaaaattagaggggaaccaattttagccatgcatagcattggttgatataagggatggcttctcaatcttggcactgttcatatattgggctggatagttctttgttgtgggggctaccttgtacattgtaggatgtctagtagtatccctggcctctacccactagagacgccagtagcacccccagtcatgacaaccctaactgtctctagacattgccaaatgtcccctgaaaggcaatatggtcctcgatcgagaccactggtttaaggtaagagaaaaataagtcgtggctgtttatctttttatacaaatgtaaggggtacaattgcagttttgtcacatggctatattgtgtagtagtaaaatatgggcttttagtgtaaccatcacccaaataacatacattgtagccatcaggtaatttctcatccctccccctgccacccttctgcgtctccagtgtctataagtccatactctaggtccatgggtacatattattaagcttcacttagacgtgggaacatggggtatttgattttctgatctgtggctgtttggggtgaagggagaaatgcaggattgctttgatttttgtcttagcaaaaaatctgaccataaatctccaagctctatggtctgtaaattcaacaacataccatgttttcccctaatgccaggcactgcattcgatcctggggacagatagaaataagacatggtccctgttctctaggtagggaccacctttttttgcagagccccagctgaggaagaagactcttgaaaactctggccatgaagtggccatttgttttccgggcagagtctgccatcgggtttctaaaaaacgtggttgggcagccacactgataagatgggaggccaggtggatttatgtgggtgtttattctgagagttgggccaaggcacaagctgaaaccgctggcaaaatgaaacttcccctggccactgtgaggaggctgaatttatctcaggggatgtggtttggttgacaagactgattatatggggtttattgtttacatgagtataatatactcagggctcaaggcagaaggtgggttttataaatcagcaggtaagtaaaataaatgcgttgggctagatactcctgctccctggataaaggtgaaaggggatggtgaattacagttaacacagaaaatgaagagaattcaaaaaacccagcggattccttcttaagcgaccatttactgccaccacccaaaggcttcatcccatttaccccacctacccatggccatatattctatgagaacattctgaaattttgtatatacattggaaacagaagcttgtctccttaccattaataaccaaatgtaaggaaatggaaagacggaacacgccctgataaacgtggggcaaagaagggaaacctgacgttgatgaagggctcctctgtagcaggcacagtggcgggtgcttgatacatacatcattccatttaattcacacaaaaatcctgtgggtggttatttcccaaatttgcctgcttataagaaccaccaggcatgcttattataaatccagaggtctttgtccctcccttggacctactgaatcctactgtctggggaaacatgaaaatctgtatttttaaccatcacttcaggggtttctaatgatcggctagattggaaaacacttcattaaactgtaattcatcatccccaagttatatggatgtggaaagtagctttgcctgacccttaattctaaacccttttcatggcttcatggtgcctccttagaaatgacaggtccaattaagacacagacaagatgggtttaaaatttgcctctgctttgcatatcagttccttagagctttgagagtcagtgtggtggagaggacatgaccgctgtaactggagtccaaggactgagttacagctctgtaatttattagctctgtgaccttagacaagttagtaaagctctcctggtcacagttttttcttctgtaaaatggtgattaaaaaaatctcacttgctccgactgcttccagatccattgtgtggaccaaatgagataatcgacgggaaaacgttttgcaaatggtaaagccgcctgtgaggtcttaatattatccattcctgatggagttgataccccaattatctgtgtaaccagtttcttttttgtgcaatacgtaaagctttgaacttttcttctcacttttgggtgacttcagacagcgtggatgatgtgaaaataaggaattcgcgtttattgacagatgaaataaaggatgaaaggtgctctctggcaaaggctgctactaaatgcaagaaaccccgggacaagccacccactgaaggcatgtgcacatgtgttctctgaaactcatgatatgtggcagccagtgctccactggattaacatggataaatgaatattaataggaccaccactctaggaaggataattgggggttgcctagatcactctctagtgactgagactgtcagagaaccttcagactcctaagcctggtcccaccctgcggcaggctgaataaataggtctttaaagatgttcatgttctaatccccagaacctgtgaaaatgttgccttacatggaaaaataactttgcagatgtgattaagttaagggtcttgagaagaagggggagattatcctggattatctaagtgagcacaacataatcacaaggatccttccaagtgaatagtggagcagggagagcacagaagatgtaatgtgggaccagagattggagtgtgatgagtgtgagaaggcgtcaactggccattgctggctttgaagatggattctgccctacagcctccagaaagaatgaagccctaccaacacgttgatcttagctcagtgaaacccactttgggcttctgacctccagaactataagataataaatgtgtgtggttttgagccactacgtttgtggtagtgttagagtagccataggaaaccagtgcacccccaccgttcccagtgtttatcagtggggtgctattgtcatgtgagtggaggctggtttctagcatagcagggcacctagcatctgattaagtactaagtgccagcctcccaaatcatttaactacccaaaacgtgccatgccctggttgaaaggcatagcttacatcgctgacacatctggggactaaaagaacatgtgggaatgggcttcagaggagcagaattttaaaaatacatttaaagcttaatggttctctttagtattaatttgctcactatgagattggaaacttctttatgcctacatgacctctgtacatccggatccaccacctggcccagagttggtgctctcaaagtgattgtgaagaaaataaatggattctttgattatatctcactcctccaaagagaatttataatgccttaaaatattaaaaagtgtaagctgaaaataatgaaatcaaatgccattaaaagaagcagagaaagagatacctagatgcctggggtgggtggtttgtttcttagctccacatttggccttgaattcctgactgcaaaaattagacaggcattacccacttgaacaccttcttaggtctcacatgtgggtcaaaggcaaattgtaggatgttaggagggacatatggtttaccagatatagccatctgaggactctcatgctaaaaatacaaatatatgtttgatctccagaaatatcccttacaattaggctagggatggttgaaaaatacacccagcttgattagagatagccagaggcatgctgctgtgaacggtttattattgagatttttggaggctatgaatgatggggaagatggcatgaagacccagatttgccgtctgtaaatcatttgagactctctctgtgtcatcatcaggactggaagggaagtcccataggctgggagtgggagatgggagggctagagtgtctttgtgtcctctggtaaagaaaacaaacccatctccagccccttgtgtctcctcctacctctgcaaagctgccaggtacaactgctctgtgttattgatgctaatgacccacgtaatggccctgcaagaaggatttcaaatctgcaaatgatggcttttgcaggcaccacaaatcactgagccttgcaatcaaatgcagagggacccagatcactgaaggacttgggataatgaatgataaaatgcagtttaatgtggacaaatgtaaaataatatgtcttggaacaaacaatcagaaggaggaacagctgctaaatgaattggtttgcattacactgaccagggaatagaaatgggcctgagtggcagccaaacaatcaacagaggtgaaggttgaagaggctggtccctgttgtaggaaaataaccccagaaaagtcagagggaggaaaatgatcaagttaattcctgcctcacaggcacctgatacgccacaaagaggaatacaaatggcctgacacccattctgagctcaatgctggctgttgctgcttaagctccttgccagctcctctgctcaacctccaaacctggggtgccccagggattggggggctaacacggtttggctgtgtccccacccaaatctcaccttgaattgtaataatccccatgggtcaagggcagggccaggtggagataattgaatcatgggtcggggggggcgtctgtttcccccatactgttcttgtggtagtgaataagtctcatgagatctgatggttttataaatgggagtaaccctgcacaagctctcttgcttgtcaccgtgtaagacgtgactttgctcctcattcacctgccatgattgtgaggccttcccagctatgtggacctgtgagtcaattaaacctctttcctttataaattacccagttacaggtacatctttattagcagcataagaacagactaatacaggtgccctaggacttgggccttggctttctcttcttcagcctcactatctcaccaaagtatctcaatcagtcctgtggcttttaagaatcatctataccctgaagatactcaaagttacaccttcaattgacctctccctagcttagatctcttagtcagtggtctcaaagttttctatgtattagaatcaccttgaggatattaaaaaaaatcttaatgtctacaccctagatgaatgaagtcaagatctctaggagtgggcccaggcattagttttaactctacaggtaattccaagatgcagttaagtttgagattaagttgcccacttaatctctccacttggatgtatacttagtgtctcaaatgtaatatgaccaaataaacttcattattatccctatttcacacttgatcatctcacacttgatcagtggatggcttccccatccactgatctctcaagccccaaaagtaagcttgatactagttgtttattttctctcactacctacagctactccaccagcaaagtcttcagttccaacttgaaaacatccaacgtcattctaccatcaagtccaacctgtaccactgcaagttttaattaatctgcttacttttggctcttctctactcacttctccctcttgtatccaaagtaatcttaaaaccaggtcatgtcacacccctatttaaaaacctccagtggcttctatcccatgtcgtataaaatccaagctcattgtcctgacttttgaaaccctcaatgactttctacatcttacctttatgatctcattttgtatcattcatcccttatccaccaggctcattcccatgtttgaaattttgcaccatttcatttgtgtaaaatatacttcctttgatcttcacagggctcactgggtcttgtcatttagatgacaccataaaaatgtctccttcttagatcattcttagtcattcaatatcaattagtcatttatcaccatgtagtattttcttgtttgttacctacaagccctcaccagaatgtaaattccacgaaacagggacctagtctattttgttcactgctaaattctcaatgcctaatatagagcctggcacatactaggtgctcaataaatatatgttgaatgaatgaatgaatgaatgaattctatcaatgaaagaaagcaaggcccagagaaactagcttaagattttatagcttatagtggccatgctctatggtttgtaccagtggtttccgggtcaagtttttgtcaatccatagtgaaatgagaacaaagacatcactgtggttctatcaaatagaaacaacttgcttatattttgagattatttacttattgcttttttgatattaaaatgtccttgctcttataaaatgctattgataatatatgacaagttatttgggagtttattttaacttcctcaacaaaataaaaactgtgataacccaataaagtttctagttttctaaaaaagttataattgtggtatccagccttcaagaatactccttaatgattcttgccacctgatattcatgctcctgtgtggttccctctcatgttgcgtagagttgaactgtgaaaccaacaggatattaagtaaatgacagtgtgcgacttccagggccacatcataaaacaccacagcttccttcttatgctcccttggatcacctgctttggggggagatggctgcaatgtcatgtgaacactcaagcagccctatgggaaatgtgtgtggtgaggaactgaggcctccagccatcagccagcactgattcaccacccatatgagtaagccaccttggaagtgaatcttctaccccagtcaagccttcagatgacttctgccttgggtgacatcagactacaacctctcggaagacccctagccagaactacccagctaagccactcccagattcctgaaacagtgaggtaatgttttttaagtcattacattttgggataatgaattatgcagcaatggataactaatacattgattaataacattccaaaaatctggagacctgcattgctgtaatcttttttgaattacggtttgcacgactggctagtttaaccactaaacatctctaagctttagctttcttgtctataacatagaaatagtattcatccctacttcttaggttgctgtgaggattaagtgagatgatgtctgtgtttggaactaatattattgaatgttatttttatcattattcttgttttatattattatggactatttcatgcctaaatgatttgcagtaccatcttctatgcctgaattgtatccctttccccatctgcctgcagaattacactttattccagacctagtacaagtatttatactctttgatgcccttcttgaccttagaagagctgatcctttcctctttgtccctgtattcttttctctattatagcacttatcatgtgtattacaattagttactgacatgtccatctcttctaccatatacaatcctaccaagcacttatttggctgttattacaggccaggtgttgtcctaacacttgtatatattgactcatgtaattgttacaataaccctaagaggcaagttctatttttatctctattttatataaggggtaacggaggcacagatttaagcacgcagtagagccaagattaaaacctgggcgtttcagctcccaatgtggtgctctcaaccatatcatccctcagagaaagggagcaccctatggacagagaccttggctcacttatgttggcctccctagtacccactagagtttttggaatatgggaagcttgtaataaaaataacagcaattattatctgctatataaaatactatgctgagaactttacaaagcagagattttaaaaatggccatttacaaatgagaatcctaaggcttagcgaggctaaataacttcatgtaaagctcctagaggtggcatagcagtcaggattccagcccagggccatttgattccaagggccattcttttttcatggcatcaaacacgcccaatgattttgaatgaatgaatgattacatgaatatgtgatggaatatcatttgtcataaattggcaaaggagaaagtgaatgatccgtgtgtacttatttctactttgagataaatataatttgaaataataatggggttattgagatataaggaaatgatgccacagaaggaagaacattgattttgtgctggacagctttctattttatgtggcctgctgattgccagtgacaatttccagtatagagactgacatcctttacaatttgagctgtccccagcctccatgtgccctgtggtgcaggcaacatgccttttctttctcttttttccctccctttcttccttcctttagcattttaaaatttatttatatttttaactgacaaatgaaaattcaatatgtttattgtgtgcaatgtgataatgttttgaaatatgtatacattgtggattgactaaatctggctaattaacatatgcattactttgtatacttgtttgtggtgagaacacttaaaatctactcttaccgatttttttttttttgagatggagtctcactctttcagccaggctggagtgcagtggcatgatcttggctcactgcaaccaccacctcccaggttcaagtgattctcctgcctcagtctcccaagtagctgggattacaggaacacaccaacacacccagctaatttttgtatttttagtagacatggggttttaccatgttggccaggctgatcttgaactcctgacctcaggtgatccgcctgccttggcctcccaaagtgctgggattacaggcgtgagccaccatgcctcggcccctctcttagcaatttttaataccacaatacattgctattaactatagtcatcatgtacagtagggctattgaaattattctaactacaattttgtatattttgactgacatctctctaatcccccaaccttcctccagcctctggtagccaacattcttctcttcacttctatgagtttaactttttaagattccatgtgtgatatggtttggctatgtccccacccaaatctcatcttgaattatcgctcccctattccccatgtgtcatgggagaggcctggtgggaggtaatcgaatcatggggatgggtattcccatgctgttcttgtgatagtgaataagtctcatgagatctgatggttttacaaagggcagttcccctgcacatgctctcttgcctgctgccatgtaagacatgcctttgcttctctttcaccttctaccatgattgtgaggccttcccagccatatggaactgtgagtctattaaacctctttttctttataaattacccagtcttgggtatttcttcatagcagtatgaaaatggactaatacaacatgtaagtgagatcttgtggtatttgtgcctggcttatttcacttagcatgtcttccagattcatctaggttgtctcaaatgacagaatttccttcctttttttttaaggctgagtagtattccattgtgtatatccactacattttctttaccattgctccactgatggacacttaggttaatttcatatcttagctattagaaataatgctgcaacaaatatgggatgcagatatcatttcaatatactgattccatatcctttgggcatatatacagtacagggattcctggatcatatggtggttttacttttttgaagaatcttcatactgtttccgtaatggctgtgctaatttgcattcccatcaacagtgtttcagggttcccttttcttcacatcctttgcacatattctccaacacttgttatgtttcatctttttgataatagatattctaagttgtgaggtaatatctcactgtgattttcatttgcatttgatgattagggatgttgaacattttttcatatacctattggtcatcggtatgtcattttgagaactgtctgttccaatcctttgcccatttttaaatcaggtgtttttactactattgagttgcttgagctcctatacattttggatatcaacttcttatcaggtgtatgctttacaaatattaatactttccttctgtaggttgtctctacactctgttgataatttccttggctgcataaaaggttttcagtttgatgtagtcccatttgcttttgttgcttgtgcttttgtgttcatatataaaaaaaatcattgcctaaactaatgtcatagaccaatgttgccttatgttttcttctagtagtttcatagtttcaggtcttacatttaagtctttaatccacttttagttggctattgtggtgcatggtgtgagttaagggtctaatttcattcttttacatgtgactatccagttttcccaacaccatttattgaagagactgtcctttccccagtgtgtgttcttgacacctttgtcacccttgctatcatattggcctgagtcactttcagatgttgctgagaaaaaaatcccaacccatgggatacttaaaacatggctcttaaaacttgatctaaaagtgctttagctaattgagatgtattgtgattccatatgaattttaggaattttttctatttctatgaacaatgtcattggtattttgatagggattgcttgaatcagtagaccattctgggtagttcagatgtttaacaatattaattcttccagctcatgagcatgggatatctcactacagttttttgttcctcttcaatttcttttcttagtgttttataggtttccttgtagatagcttttacttctttggttaatttattcttagggttttttttttttttttggtagctattgtaaatgggattgatttcttgattcctttttcagattgatcactgttaacatatagtaatgctacagtttgttttctatctacctacctatctacctatccatcctatctatctatctatctatctatctatctatctatctatctatctatctatctatctattttaccatttaccatgggaatgataggtttttttaaaacctaagattatctcatttgcagacaaggataatttgatttcttcctttccaacttggataatcattttctttctttctcttgcttaattgctcatgaccactccagtactatgttgcataaatgcagtgaaagtgaacatccttgtcttgttccagctctcatttctgtttatcaatgaatagtatttcattgtgtagatgcaccatggttaatccattaattattggcctattgaagggcatgttggtgtttctaagttttcacaattatgaataaagctcctataaatatttgtatgcaggttttcatgtggaaataagttttttattaatttaaatgaacaccaaggagtgttattatgaattgaccagtttcaactggccgtgactggctttgactggttttgagcagccatcactggttttggctgtccacgaccagcttcaacttgtttccactggttttgaatggtcttggctggtgttggccggtttcaacaggtcttagtcagttggtttcagccagtttcagccagtttcatttggttttgactggtttcaactagcttctgcgaatttccatgggttataacagatttttactagttatagccaatttggactagtttcagccaatttggactagtttcagcagggctcaactggttccagctggttttgactggttttagccagcttcagccaatgttgactggtttcattcagctttgaccagtttcagttggcttcagccatctgttttgactagtttcagctggcttcaactggtttaaagcagtggtagccagttttagctggttttggctggtttagaacagtttagactcctctgggtaattatatctttttctctttaaaaaaaaataattttaacatttttgacttggggttatatgtgcaggttacctgggtatattgcatgatgctgagtttggggtatgattgttcccatcaccaaggtactgagcatagcacccaatagtttttcagcttttcaccccctatccacccccgaccatctagcagtccccagtgtttgtgtttgtcatctttatgtccatgagtacccaatgtttacctcctatttataagtgagaacatgcagtatttggttttctgtttctacattaatttgcttaggataatggcctccagctgcatccatattcctgcaaaaatcatgatttcattctttttttatttctgtgtagcatttcatggtgtatatgtaccatattttctttatttgattcactgctaatggggggcccctaggttgatccacgtctttgttattgtaaatactaatgtgatgaatagaggagtgcatgtgtctttttggtagaacaatttattttcttttggatatataccccataatgggattgtgaggttgaatggtagttctgttctaagttctttaagaaattcacccccggctggacacagtggctcacacctgtaattccagcactttgggagactaaggtgagtggatcacctgaggttgagagttcgagaccagcctgaccaacatggagaaatcctgtctctactgaaaatacaaaattagctaggcgtggtggtgcatgcctgcaatcctggctacttgggaggctgaggcaggagaatcgcttgaacccgggaggcagaggttgcagtgagctgagatcatgccattgcactccagcctgggcaacaagagcgaaactccgtctcggaaaaaaaaaaaaaagaaatctccaaattgctttccaagtggcagaactaatttacattcccaccaataatgtataagtgtttcctttttctccacagcttgccagtatctgttgttttttgactttttaataatagccattctgacttgtgtgagatggtatctctttgtggttttgatttgcattcctctgatgattagtgatgtggaacattttgttgttgttgttcacttgtatattttcttttgagaagtggctgttcatgtcttttgcacactttttaatggggtttttttttttttttgcttcttcggttgttaaaatttcttgtaggttctggatatcagagctttgttggatgcatagtttgtgaatattttctctaattctgtgggtggtctgtttactctgttgatagcttcttttgctgtgtagaagatctttagtttaattcggtcccacttgtcaatttttgtttttgttgcaattgcttttgaggacttattcataaactatatcccaaggctaacatccagaatggtgtttcctaggttttcttctgggattcttgcagtttgaggtcttacatttacatcattaatatatcttgagtgagttgacttttgtataggtgaaaggtaggggtccagtttcattcttccgcatatggctagctggcttttccagcaccatttattgaataggaagtccttttctcattgcttatttattcccactttgttgcatatcagttagccatgggtgtatggcttatttctaagttctctattctgtcccattgttctatgtgtctgtttttgtaccagtaccatactgttttggttactgtggccttatagcatagtttgaagttgggtaatatgattcctccagctttgttctttttgcttaggattgctttggctactcatgttcttttttggttccatatgaattttagaatagttttttctatttttgtgaaaaatgatggtagcttgataagaatagcattgaatctacagattgctttgggcagtatggccattttaacaatattgattcttccaatccatgagcatggaatatttttccatttgtttcctgtatgatttctttcacagtttttgttttgttttgtttttgtttttgtaattctccttgtagagatctttctcctctttggttagatgtattactatatatgtgggtgtttgtgtgtggctattgtaagagggattgtgttcttgatttgactctcagcttgaatgttatcggtgtatagaaatgctatatttttgtacattgattttgtatcctgaaacctcactgaagtcatttatcagtgccaggagctttttgacagagtccttagggttttctaggtatcatatcatcagcaaagagagatagtttgactccttcttttcctatttggatgccttttatttctttttcttgccagattgctctggcaaggacttccagtactgtgttgaatagaagtagtgagaatgagcatccttcactttttccagttgtcaaagggaatgcttccagcttttgcctattcagtataatgttggctgtggttttgtcatagatggctcctattattttgaggtatgtttctttgatgtcttgtttcttgagggtttttatcacttagggatgttggattttattaaaatctttttctatatctattgagatgatcatatggtttttgtttttaattctgtttatgtggtgaatcacatctattgattcatatatattgaaccaaccttgcatcccaggaaggaagcctatttgatcatggtgaattaactttttaatgtgctgctggatttggtttgctagtatttcgttgcagatttttacatctatgttcatcagggatattgacctttagttttcttttttgttgttgtatctttgccagggtttggtgtcagggtgatgctggctttgtagaaagagttagggaggagtcccgcctccttgattttttggaatagtttcaatagagttggtaccagctatcctttgtttatatggtagaatttggctgtgaatccacctgatttggcctttttttggttataggttttaaattactgattcaattttggaacttaatattggtctgttcagggtttccgtttaatcttgggaggttgcgtgttttcagaaatttatgtatttctgtgggattgttgtaatgttaccttcgcagtttctgattgtgcttacttggatcttctctcttttcctttggtaatctagctagtggtctattgatttttatcttttcaaaaagccaccttctagattttttgattctttgtatggatttttgggttgccaatttcattcagttctgctcaattttagttatttcttctcttttgctagctttgaggttagttcgttcttgtttttctagttcctctaggtgtgatgttagattgttaatctgagatctttctatgtttttgaggctggtgtttagcactataaactgtccccttaacataacttttgctgtatcccacagattttggcatgttctgtctctgtgtttatttatttcaatgaattgttggacctcttggatagaaccacaaaagcataggcagcaaaaaacaaacatatagttgcatcaaactaaaacgagtttgatgcaactgtattcttctgcacagcaaagaaaacaatagagtgaagagacatcccatagattgatatgtatatacatctgtgtctatgtgttttggctttgggaaatcagtaaaccacaggactttgattttaatttatgtacacaggtaggtatctcccaggggcctcttaagaggtaataatgcaacgtaatgaaaaaaaaaaaaagcaccgtgttagagctgaactgtactagtaccatcacctatgtactatctccatgtgggcaaattacttaaactctctgtacctttgccttcctatcagtaaaatgggaacagtaacatgtattttagcttcatggtgaggattaaacataaagctctacctgacttgggcttcccattcatctctgagcttatagcctaagatactccccctacagcacatttctttccagctaccttagtttcttagtcattcctcaaattcactgggcaagtgcctgcctcagggcctttgtaccagctcttccctttgctcaaacattttcttctcagatccccaaatggctcaccacatcaagtcttggctctcatgtcccctcctccatgaggcttgtcctgactcttctgattagttctgtatcctcctcctgccactctcaagaccctttgctttgctttctcttctttccatagcagttaacatctccttgtagatgagacgttgtatttattaattagtatctatctccaactgctagaatgtaagccatatgagggccagggtcttcgtgttttacactggtttatccccagcaactagaacacagcctggcacatagaaggcaccccataaatattcactgaatgaataaacaaatgaatgcatgaatgaaatcactcagtacagtgcctggcatattgtacacatctaaggaatgtagctattattgttgttacctggatttccccaggatacttcatcctggaactgtgaataattttaatgcccaatttcactacttgccaaacctgcacatctgcaggtgtcaccctcctttttgactactaccctgatgtctcctccagtcatttataattggggcccaggtggccatctgattttgttctttagctctggacttgtggtggcatcatgtacttgaagtcctatgggggtggcccctctctgtccagcagctgctgccctctgtgggatgctgctttcctgcctccctgctgggtcctgctgcttcctcatcaccttgccagacacagcagatgctgctgctgctactgttgctgcttcccatcctttctgattgctgtcgctatgttctccctagaaactcagaaaatgctctgctccctcaccttccgtctggctggctcatctggaccctgaagtgaagcagcgtgtgctccaagcctttcaaggtcactggacgaaacaagtcttcttcagttttcacttaggaccagtatctgacaaagagatgccatcgtgcccttaatgttcttgtctcccttctgtttttcttcctgctttactgaggtataattgatagaaggcaattgtatatatttaaggtatacagaatgactttttaatatttgtagacattgtgaaataatcagtcaaattaattaacatatccatcacctcacatagttaccttttctcttttttctttgataggaacacttaagatctaccctcatacaaatttcaaatacacaatacggtattgttaactgttgtcacttatagtgcattaaatctccagaatttattaattttgtatactgatactgtaccctttgcccagatctcctcatttgcctctccttccaacccctggtaaccaccacctactctctgcttctgtgagcttgactattttagattccatatataagacatcacatagtatttgcttttctgtgcctggcttatatcacttagcctaatgtcttccaggttcatccatgttgcaaatggcaggatttcctttgtttttaaggctggatgatattccattttcattacccattcatctgttcatgaacattatgttgtttctatatattggttattatgaataaggctgcagtgaacacgagagtgccaatatctgttcaggataaaaattttatttcctgggccgagtgtggtgactcacgcctgtaatcccagcactttgggaggccaaggtgggtggatcacctgaggtcaggtgtttgagaccagcctgggcaacatggtgaaaccccgtctctactaaaaatacaaaaaaattacccaggtatggtggcgggcacttgtaatcccagctacttgggaggctgaggcaggagaatcgcttgaacccaggaggtggaccttgcagtgagccgagatcatgccattgcatgccagcctgggtgacaagagcgaaactccatctcaaaaaaaaaaaaaaaattatttcctttgggtatatacccagaagtggggttgctggatagtaaggtggtttgaggagtctccatagtgctttctagctttctttgaactaacctcctccccttcttgcaaccggagacacacacagcccccaggcctactaattcctgcaaatgcttgtctgccagcaggtggctactggtccctcatgttcagtttttgcttagcttcagcgaagacatccctcgagagcataagaaaaaacagtcatcatttttaaaaatacagaaaaaatctattgctttattgcatgttggtagactgctgttccctttgacagtccagttctgcatgacaagtctacttgcatgtcccgacagatggcccatggtaacggggcattgctgatcttgttacaatgaaatctattcaatgaaaaattctccccagcagatgtgtataccagcttcatccccatgtgggtatcaatctctttatgagacattgttttggtggtatttataagcagacagttgtaggataaagagagagaggtgactgctattagtattaattatgatctcttgcatttagtgcttcatgctttttcaaaaatgtttccacagctgttcctttatttgattcttgcaacatccccatggggtagacatcagagatgaagggagaaggcatgcaaagtactttccttccttcctttcaagatgttagaataagtttgcaccatggttgtggccatcaggtggtaggctgcacgatgctgcagagagaactagactgggaatcccagctctgcctttgaaataggagagcatccttggagaactggtgaatgtcccggtcagtgaagtagtcttagccgggttgctgcagtggccgcctaacaggtctcactgctgtctttgtcttgcttccatctgtcctcagtgcagcagccagaggggatgttttaagtcatacttcagataatatcgctgcactgctcacagaccctcccaaagctctccaccccactcagagcaagagcagaatcctggcaatggctgacaagacccctgggttttgtccgacatcttctctggccccttctcccacctccgtttgctcatgctctggccacattggcctccttggtgctccttgaacatggcacagttccatgggcctccacggcacctgcttcctctgctgccacattgttccccacctgtgcttggctcaccccctcatggccttccatctgctcgtctcaccttcacgtctccgtgaagcctgtcccaatgactgtatgcttcccttgcctgcctaacctctccttcctaatccttctcacctgttctctggattgcttttcacgacagcacttaccgtcgcctaacattccgtaagtggtcacgttcctgggctgtcggaacaccacaaactgagggacatagatggagctggaagccattatccttagcaaactaacacaggaacagaaaaccaaacactgtatgttctcactcataagtgggagctgaacaatgagaacacatggacacagggagggaaaccacacaccccggggcctatgggggtaggagtggagggagcagggagggagagcatcaggattaatagctaatacatgtggggcttaatacctaggtgatggatggataggtgcagcaaatcaccatggcacacgtatacctatgaaacaaccctgtatgccctgcacatgtatcccagaacttaaaatttaaaaaaacaatttttttttcaaaagtctgatatcaaggtgctggcagggttggttccttctggaggctgggaaggggatctgtgctatgctctctcccaggttcttgtggttgctggcaatccttggtgttcctcggcgggcggcaccatcactccggcctctgcctctgttttcacatggttgtcttctgtctgtgtcccaatttccctcttctcataaggacaccagttgttggatcagggcccaccttaattcagtatgacttagtcttaacttgattaagtacatctgcaaagaccctggctccaaataaggtcacgttcagaggttctgggggttaggactgcaacatagctttttggagactcagttcaacccataacactctcatttatttatttattttttttatgtttcttgtttgtttacctctgctcaataaattctgcgaagattggggcctttaatatatgagctggtaggatcccatgatactcacaaatgtcagcttccttccctcaagttcttaatccttttaaatattatttatatccccaaatgaaagtctcataatagttaactctcaattattcacccatgtttggtaacaggccaagaaaacaatttcacagtcatttgtaatgtattgccagaaaaatcctattttgacaaattagacattctatcaaactttctagcttgcattcacattccatttacctagaggctgccacagttctacaaaaggttttacgactagagacagagttctgagacacattgtctccactcagaacctctttctgtggaccttgtagtcaccatgtgtacctccggccaccccatcctgccctgggtcttgtcctcaggttggcaccttacccagatgtcacaaatgcttctcagaacctgccaaccagactacagaatcagacccctaccatgtgagagtcagaagggatcctaaaaatcattcatttgttcactttacaatatatttcttgagtcagaagggatcctaaaaatcattcatttgttcactttacaatatatttcttgagcacctattatgtgccaggcattgtgagtttcctattctattccctttgaacctcacagcactgtgcaagatagatattatggtctctgcattccagatgagagcacagaggcccagagcagttgggagacttgctgtgactactcagctagctggcggtagacccagattcagatccagcattgcctggatctggagccctttatatgaccttgccttgaactactgggcctctgcttttcaatcactctcatccttggtggcacacaagatagccaatagaaggctggtgacaggtcattcttattctcaggcttgtagaaaattttgtatactagttgacattttctcttttacagagaatctttacctttataaatcactttcatgaaggcagaggaggtgctgtgtgatggtggcttccacctggaccccagactccctctccgcctttctctgcctggggagacccactgtgtgcatggcactcactgactcccatacctctggctatcaaaggtttctgccatggccaccctggaaggaaaccagagggaggtagacagggagatcaggtcccttctactctggttcctgctctgtgaaattgtctcaggctggctgtgtccagagggtccctggttctctcagggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagaggaatgtccaattggcctgagataagcctctggtaaaatgtactgtacataataggtaatcaataaatgttggctgatgacaaacatgttttctttgttcattagttatagtgattatgttctaaataactccaacaaggaagtcagcacatttggaatatcattatctttccatgataatatctttccatggaaagataatgatattccaaactgggagtgtccctagcagatctgagtctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcagggtcctcccttaatgaggtgtgcgatgtacaagagtcgtgaggtggcaaaggatgggctcctgaggaaacacttaggaaactgggctttctgccattaaaagagacaaacctttgtggtgacctaattaaagtttttaaaattcaatttggaaagttagcaagctaggctcctttccaggaaaaataaggagtcagtgcatgacctaaccggtcccgggctgcttgccattccaaacaactgcagtaagtttatcaccttctttcagggactgaggtttccaggcacagacttggataagaaggatgtcctatggggtcacattgatgctgtggcccaagagaggttgccatgactcgagaaaggttatgaagtatggttttcactaaaggaaaactgatctctttcgattgtttctatggaagcttgtggattataaaacagtatcctttcaaatccatccatccatgtactaacccatctatccgtccatccattcatccatccatcaatgcatgcatgcatctatcattcattcattcatccatccatctatccacctattcttccggccatttatttatccatccaacatatactgagttgctactcccaccaaacactggagattctatactaaatatgacataaccaatactttgaaagagcccaggcttcatgtaaaagcacacaattgaaacaatggttacaagcacaaggcgttaagtcaaaagaccttggtttgagagttgactttgtaatttaagtggccctgtggtcttgggcaagtgtttctctctaggccacatttttcatccgtaaaataatgtagctgaactcaaggaatgctctctaagatctcttcatggtcagatatgctaagattctctgtccaggcaaattcagggcaagatgagatcatcatgtgagtgcagacagtgcaataatctagtcagtggtctcctctgtccaccttgcccatccactctatcttctacagtgtaggcagagtcatcttttcaaaagaaaatctatcacagctgggtgtgatggctcacgcctgtaatcccagcactttgggaggcgacagtggtggatcacctaaggtcaggagttcaagaccagcctggccaacatggcaaaaccccatctctgctaaaaatacaaaaattagccgggtgtgatggcatgcacctgtaatcccagctatcagggaggctgaggcaggagaatcgcttgaagctgggaggtggaggtggaggttgcagtgagccaggatcacgccattccactccagcctgggtgacagagcgactctgtctaaaaaaaaaaaaaagaaaaagaaaaaagaaaagaaaatctatcacatcttttttttcattcatccctgcagtggtggattctattcctcttcggctaaagatcaacattcttaaggaaggtcttcgcagctcttcccagttctccagctcattttgtattaagccttgacttgctatctttgctccttaaacttgctatgttccctcttattacaaggcttccgtgtggcccacttgtacctttccccatcttctatcctgggagaactgctcatccttcagatagcagcctactcaccatttcttcagggacactttctctcacctcccaggtgaggcctggcttctatatatacacatagatcaatgtttcttccttttagagcacaaaccccaaccctgaaccatagcagaggggatccttagtttaacatctggctgccccaccagcttaccaccctcttgggagaaggaactgggtctagtttgctcactactgcactccctaaaacagtgcttggcacatacagggcccccagcaagcattcgtctgaacaaacatggagaatatggtgagtgccctaggctgacaaatataaattcctcatacccggagatgaggacaggaaatagcatccttattggggtaattcacttgaaaaaaaaaatgcctcaaaagaaatccacccatatgttgtaaactcactgctcataagagcaaggtgctctctaaaccccatcaggtagcccacagtgtctctcaaaccttaagggggaggacccttttgaaccaaaatggatgcaacaatagctgtgaagccactgctgagctgctgacggagggtagaggtgacaggtagagatggaaaaaacaaaaggccagagagacagaatttgaccaggggtctctgccactgtgcaaggtaggggtagtttttttcagtctagaatattggttaagtagttgaaaaagccctagaggaaaaagaacaatccataattgttcctgagtgtggttaaaaagcattttgagtaggaatctgtgtagcgcagtggttgagggaatgtcagacaggtctggttgaagtcatagttccagcaccgagtagctgcgcagtgctgggcaaatcactttgctctgagcctcaatttccttatttatggggataatggtatgtttaccattgggctgttggaagaagaaacggaggatgtaagctcatgcttaacacaaggcctggcctacactcagtgctcttaagtgaaagctgttgtcagtgagatgaattactttgtcataattctctgctcacctaactgtccatctggtctgcatttgattcctgagtaaagccatttgccagaaatgagctctcatggaaactgtacatttctgtggctctaaaccttgactcctctctttttctccatagcataccaagtctagcagtaatttgtgttggctctcctttcaaaatgcatgcagaatccagttgcttctctctccttttgctgccactgccctggttcaagctatcagcatctctttcccagaggactgtagtggcctcctaataggcctgcctgccggggcctttgccccctatggtcttctcttggctaacagccagaaaaaacctgctaaaagctaaatcagatcataccactcccctgcttgaagatgtctgatggccccatcacacttagaagaaaatccatatccagatccagtcccccaaaaccttcaggattccacattagccaacttttttgatcctatgcactctctcctaacacataggttccagctacagtggtcttgccacacaccaggcacactcctgcctgagggccggaaacctctctacctagaaacttgcaagctggcctttccatctcctttaggtctttgttcatatgtcacattctagctgaggccttccctgactgccttatttaacactgcaatccccaccccacactggacgccttttcctataactcatcccctactttattttacccacagcgcttgtcactatttgatccttatatattttacatatttgtctattatctgtctctcccactaagttccattacaaaagagtttttgttctttttttgttccctgttgttcctcggtgcctagattctcatagaagcaatgtgctaggtgcttaataaatatttatcatgtgaatgaatggtcagcccacttcttggggtgaagccttatgtgtatgctcagaaactgtcctggcttataaggttagtgtgggccaggctccccgagcattctttttatagagattctgctaaaatcaaatttctgaatcctctggactgcagagtcagtctggcaccttagatgtccctgatacccagcctaagctttaggcactgtgacacatacttttaaaggtggagaatgagtcagaatctgataaggtataaatatttggttactcacctcctgaaggtgaattagctctcacaggttgccagaaatatctctcggttccctgaagctgaaacacacttgctgatgtgcattaatagccaaaatggtaggaaatggcagagtctgccattattcatccacttaccaggggaggaaagaagataaatttattgtatatgaatgaattaacacaggcattgtgcctgttgagcaggtgtgcagggaaggaaagtggatgaatatgtgtgtgtgtgtgtgtgtgtgtgtgtgtgtgtttctcatgttcctatccttaatcaagaaaatggaatcccttctggaagacctcatgaccacatttgaagctctaccatttttctgttttggagaatagtggtttgggttttatagaaaaactggaggcagctctgagtaagagaaacatggtggtggtgatttcccagaactcatcgggcttctccaagttgggacacatgttggtcaaaggatgagctgctggcaattcatgatgaagacactggagtggataagacactcatggagacacttaaagcaggacaccaacctaggaaggatctggaagtagaagtgagtggaagatggcactaaaagtggaagaaaatcatgaaagacgtgatctgtccttgctgcttcagtgattacaagtgggctccagcagtccttccaatcagattctattattgaagaccagtgtattatttaaatgcttctctcaggagcttcgaaaggaggcagagcgaatagagagggaaagaaaagagctctcatgcctccactgtggcttggcactgggtgggtagggcacaggtgctggatggcaaagcattggcttgctgctctgatggccatgctgatgggacacagggaaggagaggcactgaacacttagactttcacagaattttcaatatcaatatgcaacttgtgataggttgtagttaaataaatttgttgttgtttattaaaactttttgcatcctcatgttgaggaactcaaagtagaaaataatgtctgtagagaaagtatacttttccccaggtgtgctgagtggcagctcttatccagtgacgtatactatcaaaaataccaacttggactctgtgatggttaatgttgagtgtcaacttgattgcatggaaggatgcaaagtatttttcctgggcatggctgtgagggtgttgccaaaggagattaacatttgagccagtgggagaaggagacccaccctcaatatgagtgggctccatctaatcagctgccagtgcaggtagaataaagcaggcagaagaacgtggaaggactagacttgctgagtcttccgatcctcatccttctcctgggctagatgcttcctgcccttgaacggcagactccaagttcttcagcttttggactcttggacctataccagtggtttgccaggggcccttgggccttcagccacagactgaaagctgcactctgtcatcttcccaacttctgagatttggggactgggactggcttccctgctcctcaggttgcagacggtctattgtgggacttcaccttgtgattgtgtgagtcagtactccttaataaactctccttcatatatacacctatcctattagttctgtcccttcagagaaccctgactaatacagattctgagggcagaaactcattcattcatctattcattcatatatccatctattcatttacttgctcatctagcaaatatattttgagcacttactatgtatcgggcagatgtcctgatacagaagtcaacaagatgaacaaatccctctcttgaagcttgaattacagtggggaagacaataaataaaaaatagaaaagataacttcagagagtgaagagtactgtagagataataaaatcagtgagtgatgtagagagctctgggggcttagagttcaggctacttcagataagatgattagggaatgcttctctgggaagggatcttggtgctgagacctgaacaatgggaggacccagccacatgaagatttaaagtgatgactcacaacctttgaagtgcattcatatcacctgggagtttttaaaaatagatggtggaccccacctccagaggtggaaatttaattgacctcaaggtaaggcttaaaattattctaatgtgcagccagggttgcaaagcaacctagactagaagtggaacttactagacagaatagcatatgcaaatgtcctcaggtagggaatggcttggagtgttccccaggcagaaagaaggtaggtatgactgaattagatggaggtaagaaacaaatttggggagggagtcagggattatattcgcttaggtgagctggtgagcatgtcacagatctagagctgggccccacagtacacagaagtacacagaaaacaagagctccttgctgcgtgcagtggcattgtcttgtgaggagccagggagttggaatgggtggtagggagaaaccccatacatttcacttcttcagtgtcatcacacagcaaactaatctgaactgcagaatttctctggtgatcagctgcctgttttcctggggtgatccatctatgaaaagtttccaaattgtgttaaaactgccagtttctcgacaaacagcacggagtgtactttccagggagaaaagttcaataattaaaatgagtcagcactgaagaactggagggcggtttgatctagtttagcagccgacgttttcttagcagaaaaatgcaatatccataatacataattttgtgctgaacagaagtcaactagaacagaattgtctcaggagggaccaaagtcagcttgccagaaaatctttttgaaggcagcagaaaacctggtcttcaaaagctgaagttggggagtggctgaggggccatgtctcaggtgcctacaggctggaggagctccctgagctgttttgacagggactcccctcttgctctctccagagcaattttaaagggcagataaacacaacacccaggttgtctgaacacctggagttcagaagcctgacttctcaccaccagcagaaagacctacttaatattgggcagctcttattctagggactaagtttgcctttgcctggggtgttaccacaggaggtgggagtttgggggtaattttttgtttttctgagaaaagaagagtgattaaaggagaaaatcatttcctctgggtggtaagggtccctgcaaaacatcccccgactgagcttccaggaagagtgaaaactgccaaacctgaaagtggtttggcttggagtctaagtccccaccagaggttgcaagtcctccctgtgcctgcagcacagtctcttcctggggctggctccgcgatttcaaaaacatagacaaattggctctcttctggcctcctgaagttcatgcaatcatgggaccaactaaatttgtgttagattatgccaaagactgaacaacattttgctttttttttttttttttttttttgcttcactgacaatagtccaagagaggaagccttcaattagagtagcagaaaatgctgattagaatcaatcaacacctctagaagtttaaacacttaagttaattaaatggttcagtaaacttgaagcgaaacttgcaaacagaaaacgcgacgtataaaaggatgcttagatttttaaaaaacagataattatccaacaagctcaacatcaacctcaccaaaggctctgtgaaaatgattaggcaggcagcgcattaattttcaatgcaactcacacttaggttcatatcactactcaaaagcaaaaactcatgactcctatcagcgggtgtgttgttctggtttcgagatatactattaggaaactggcaatgcacctgttgtattttagtagtcctgaatattttaagagatcactgtttccttaccctcagtacaaacaaaatcctgcaaagacagatctttcctgcaaagcaaaatcttgctggttttgtttaattttaggagaaggcccaatctgaatgagtgaaaacatgaaacacagattttttttcagacactaaaaatttgtaactcttctgctgcaaaataaagtcaaactagatgtcttctgttgggttcctttagacacagcctgcgatggagagtctagttcaagtgttttcctgaggatatggtccccagaaaaggggaaggaggaaagcgggacagagctgaaacaaatatctaagcaaagcttttgatttgcctgcagattgtttcagtctgagcccataggagggcgctggagtatgaatctcacaacaaaattagttccacctgagacaagaagatcagcctctgatgccccttggcatgtatctattagtcatgggccgtgggcttctgctgggggtgaggtgggaatgtggtagcctgttgagcagttagcagagggcagtcccccaggaaaagcggtggctgtgaggtgtaatcagacaaagtcacagctgctgggggagaggggcagcggctaccgatgggatctgggcaggaggtctacatgactggaccaaggaacttctgcctcatagagattgttgagtgatcttaggcaagacaaaagttgtctttgataaacaagcctattctaaagtgagagctaccccaggctccagacactatcttgttcacctctgaacataatgggtcatcaacaaatgtgtgttaagtgaatagcaaacagatcacttgcagtgtccactgaatatgatgcagcttccatgccctttctacgcatttcacaaacacccactgaagatgaagcaataacttgctacttgaggttcagtcccatcagaagacatgggttgagcccttgtgtagtttttcattagtaatgatgccttgtacctcagttgtccaatctttaaaatagggaaaaatcacaacatgacagggcttttgtgaggattaggagaaatagcacatgaatatacttagtaatttagctttttctcataaaatgtttttctttggaaaaatttcagaaaagctgaagtgcaggaatagagacatttaaagctaaaggattagaagcctctgataataaaaatttgctctgtaaagataaagcaatactagaactgtgctgtaaagtcaataggcaccggggattgatattgatctacagaatacacttgtaggaatgaagctactccataaagccaggcacattgagaatgagcatctcattgttttatctcccaatatagtgtgcaggtcaggctctgaactcttcttaactagaaagatagtgagttgcaaataaaacaggtgttggccattaatgaggtctctacgcacaacacttactatactacctctcagactatgtggagtggtttcttcttttgggggtttgccaaaaacaaagtaacattgcctacgaccttccttccataaaggcaggaggagggtgagtgtctttgtctgcacaggacacacagctgcaagaactctgtgacttggtgttcccactgtctgattatctgttgtgtcctccacagatcctcttttcttgcccctgctgggaagctatctctggttctagagcagaaggccatcacagaaactcagccaaacagtaaattggaggtgaggttttcaccaggaccatgaagacttcacttcttcaatcgggtaacttcccaaagaagtattttcctactttagagatgtggaaggattgggagctgctactcaagatgatcttacacatgcactgaatggtttgagcatcattcttatcattgattaaggggctggatcaacggctggacttcaggcatggtcagaaggaaaaaggagcctataattggccatttcttggctgggtcatgaccacagcaagggcatagatgtttaataggcagtgtaaggttacaattccaaatatgcattaactgaacccatcaatgatatctagcggggacaacgggaggacttgaggacaattgatgatggtaagtcatttgacaaaaatagggcctgaaaaaatacaaattttggttctatatcttttgaaaaatatcactccttagttgtcacttaagcctaggaccaaaggctagctagcttccctaatcactaggcttacttactagagcaaagggtagagtgtgggtacaggcatctgttgttatcttgcccagcatatatttatttatccctcttcccttggtaacagcacccttcctttcctttgaataactgtgcctactgcatttccatatggccctggggggcaccaatcctggtaccctgttcctgggtaggttcatgaccttacaggttggccagactcagtctcccaggaatctgaattataggtggagtgaaatatgaatggaaggtgaatgaagacaagtcaatttgatggcagttctcagaaagaatgaatcggagatccctggtactgacctgatgttcctgaccttcttgtggtccttgattctatgagttacttagtgttctctcaaataaactaatccttaaattaactagagtggcttttccgtttcttatagtcaaagaacactgagtgctccctgccatggtgcccctaaggagagaaaggccagtctctctttcttttgctctgtctgtatatgtgtgcatttgtgctggtataagcactgacaccagttcctgaggcctccataaaaggtacttcaggccccttttcaatttgagaggcagggtgtgatattattatatgttaccatccatctctttcttaaagaggcaaagtctcataggggaacaagcatagattttgcaatccagaaaaaattgagtttgactgaaaaaactgagttccgtcatttgcaatttatgtaatcttgggcaaattctgtatcctttcacctttgtcacctgtaaaatgggtacaataatacctgtcttctcacaggggtttgtgagatttaaggcagtgtataaaaagggccaagtattgtgacttgccctagaaaaataatttccttcctccctctggagctctttgggaggtgggctggggtcctcatcactatggttattttacaaggttggaccttctctagatacctgatgaggccacattcaggtgggtgggtagagacacactggtttcaaacatgggagatatgactgagaaggcgatgattgctcttgctaagacaatggacttcggtggtgatgggagaagcttagtttagatgcaagcaagaatgtgctcagatggagagagaagaaggaattacagacaaaagaaatctgcagaacaccaatttttaaatctacacctatgagggatgatttcagtttgtggcctgaggagagagtgggcagggaggaattggaaattacggctcttccttcacattcgtgattcggctaaatgggtgctcattattcagagaatgaaaaaaatagcagagcctggtaacacaagagcccttttctcaaattatcagtactttataagaattctagcttttcaataatcatagttcttatagctttatgttctcacattctaagtttgttgtggtgaaaagaacaaaataagggaggatgatgagttcatgtctttgtagggacacggatgaaactggaaaccatcattctcagcaaactattgcaaggacaaaaaaccaaacacctcatgttctcactcataggtgggaattgaacaatgagaacacatggacacaggaagcggaacatcacacaccagggactgttgtggggtggggggtggagggagggatagcattaggagatatacctaatgctaaatgacgagttaatgggtgcagcacaccaacatggcacacgtatacatatgtaagaaacctgcacatgtaccctaaaacttaaaatataataataataaaatttaaaaaaaaccaaaaaacatatttggggagaagcttccaagtaattaaaaaaatttttcctttttaaaaatttttgtgggtacataatgcttgtatatatttttgggctacatgagatgtgttgatacaggcatgcaatgtgaaataatcacaaaacagggaatgaggtatccatcccctcaagtatttaccctttgtgttacaaacaatccaattacactctttcggttattttaaaatgtacaattaagttattttaaaatgtgcaatttattattgactacagtcatcctattgtgtgatcagagagtagtcttgttcattcattcttttttttttcagacggagtctcgctctgttacccaggctggagtacactggctcaatctcagctcactgcaaactctgcctcctaggctcaagcaattctcctgccacagcctctgagtagctgggattacaggcatgtgccaccacgcctggctaacttttgtatttttagtagagacggggtttcaccatgttggccaggctggtctcgaactcctgacctcaggtgatccgcccacctcggcctcccaaagtattgggattacaggcataagccaccgtgcccggccctcattctttctaattattattttttgaacccattaacaattcccacctcccctccagccccctactacccttcccagactctggtaatcatcctccaggtaatttgattcagaattttgtgtttgttttcctaaatcaataactactatacaaaacgctgtgaaaatggctactattttctttcttttgctccccacctggggacggtcccctgggtcaccttactcagcagttctccctctagatttgatccagcaaatgagatcgagtgatatattatagactctttaatcattttcaggggaattgggttgggatggaagagccctgggcctggacgtgactaatctgagggaactggatcagtatttttgggagaagcacacctgaggcaagaaactacccccaaataaaaggatgtctaaaatgctcatggttctctccccttttttggcctcgaaaaatgatatttattcagagaaaaaaagaagagaaaaaatgccaagaagttcacccattggctaacttctctgtcccctcctggttcttgccagccccccagggttgagctctggttggagtgggtagcagggctgcccctaaggtgatgtcagtgacatggttcaaatactgtctcaccacttaccaaggtatgaacttggggttcattaagctgcagttccctccatagcatcttgtaggggaattatttaagcatgtgccgtgtaccctagtgaattacaggcctcaataaatgttgaattaggtataaaatcctttcctttatgcacccttcaatcttaagacctattactgaacaatgataggaaattggtttttcattcaacagaaagcccaaggttggtcaaggtcatggtagggccagcatttgttcatcaagtttatagtcttctgagctttgaaaatgttggcagggagatcttaactgggatgagacacagagagatgaattatagtgttacttgagtaatctatgcaataggttgctgccatctttggaaccctcacttgtgaaataataagaaatatacatattgttctctgtccccagtccctggcacagagctcctaaaacccttgtaatttcctgagtgataggagtgctaggggaatttttttgttctaatgcttggcttctgctgaagttcctgagagagagctccgaatacccctgtagacagaggtgctagaattttttagcatttggtccttgaccccaattttctgacacagagctcctaaatcccttggaatttcctgggtgataggagcatcttttgttctaatgagatgactcttggtgggcacctggctagcccaacattggcctgttggccaggaaaatgaaccatgtgattaaaagtagtactactatttgatccagcaatccagaggaaaagaagtcgttattcgaaaaagatacttgtgcacgcatatttctagcagcacagttcacaatcgcaaaatcgtggaaccaacccaaatgcccgtcaatcaacaagtggataaagaaactggtatatatatatatatatatatatatatatataatattacataaatatataaaaatatatatttgtgtatatatatacatgtatacatgtatatatgcacatatatgcatgtatatatacatatatacgtatatatacatgtatatatgtatatatgtatacatatatgcatgtatatatacatatatacgtatatatacatatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatactcactcagccataaaaaggaatgaattaacaggatttgcgacttggatgagattggagactattattttaagtgaagtaactcaggaatggaaaatcattgtatgttctcacggatatgtgggagctaagctctgaagacgtaaaggcataagaatgatacaatggactttggggacttggggggaagaggaggagggggacgagggacaaaagacatacaaatatggtgcagtgtatactgctcaggtgatgggagcaccaaaatctcacaaatcaccactaaggaacttagtcatgtaaccaaataccacctgtaccccaataatttatgaaaaaaagatttaaaatgaaaaaaagatttaaaatgaaataaaagccaaagcagcttacagtaaaaataaatagataaataaataaaaataaagtattggaactttcagctccacctcaacctccaggaagaagagagaggccgaaggttgagctaatcaccaatgaccaatgacttaatcaattgtgcctaggtaaggaagcctccaataaacactcaaaagcactgagttctagaggttcctggaaggcagtgggcttggagagggcacagaagctcctcaacccttccccataccttgccctatacagttattccccccggctcttcatttttatcttttgtaataccctttgtagtaaactggtaaatgtttctctgatttctgtgagctgctctagcaaattaattgaacccaaaaaagtggtcatgggaacatgggttacaacctgtgcttattatttggcctctgaagtggggggaaaactaagccctccatctgtggggtctgttgctatctccaagtagatagtgtcagaattgaattgaataagagaatacccagctggtgtctgctgcagaattgattgcttggttgaccgtgggaagaaatcctcacgtgttttggcaaccagaggtcacagaagtgttgattgttgaatgagaggatagaaaaaaacactttgttttttcttttctccatatctcatactactgccctgaggatgtcttctatacctctacttatagcacagcatcacacatgggaagcatggccaggtccaaaattggtcacactttcctctgacctcactccagctctttattcccttctgagagctcatctgagcataccacacatcagcatgtgtgcaaaactacattacggagaagagggatttgatgaatcataaaatctcacacagtactggaaaaagtccaggataaatgggctttgaataaaataaatgccaccagaacccccacataaatgatgcatgacatcgcctgcaaattgaggcatgaaggcatgaaattttaaactcccagatggctcctccttgttcttttcaacttgtcctcacaaaacttgtgcaatagctacacctctcaccactgaacctaggtgacacctgaggttcgcttgttgctgaaaagtagactagaaagttgagtcattggggaattgaagggaagatccatggtgtatttcccccgtagcccagcatctaatacaaatttgggacacagcaggtctcagaaaatgtttttggcatgtttacaaataggaagaagagctgcctctgttcaagagaagttaagacccatcagatatctttcattcatgatatcccagtcttatgttggggtgatttaaaaggttaagtattggctgggtgtggtggctttgcttgaaatcccagcactttgagaggctgaggtgggagaattacttgaggccaggagtttgagacaatcctgggcagcatagtgagatcgtatctttacaaaaagtaaaaaaaagttagccaggcatggtggcatgagcctgtaatcccagctactcaggaagttgaggtggggggtgtatcacaagcccaggagttcaaggctggagtgagctgtaatcccacaactgcagcctgggtggcagagccagggcctgtcacaaaaaaacaaaacaaaacaaaaaacttttgcagccttttaaggaggcaatgaagtgggctttgatccagataggctggagtttggtgctcaactctagaacataataggcataaaatctctgaaccctggttttccagcactgaaaggatgataataatactaagagtaataataattgtggtataataagaaatattatttggtttttgtctgtggttcttgccacagaatttctaaaactcttgggatttctggcctggaatatgtaggcaggaggaatcttaagtaggatgggacatctagaatgaattattctattgagtaatctatgcaataggttcctgccatctttggaaacctactgcagtgaggaagtcttctgcacttccttttatagcacagtattatatactggaagcagtggacatgcctgaataagagtatcttttgttattcataatgaacacttttaatcatatctgagtttatgctaatgaggtgacttaaggtggggaccctagatagcctcaggaagaggctggtcaccagaaccaactcagtagagggttgaaacttcagtcccatccaccagtctgaaaactggagatataagctctataaaaagtcttgaacaacaaatgtccatcaacacataaagaaaatatggtatatatacacaatggaatactatacagccttaaaaaggaaggaaattatgtgttttgcaacaacatggatggaactggaggacattatgctaactgaaataagccaggcacagaatgatgaataccaactgatctcacctatatgtacaatctaaaaagtcagtgtcatagaaacagagtagaaaggtagttaccagaggttggtggagagagggaaggagaaagggtagaaaatttcaggtagactgaaggaataggttttagtgatctattatgctctgctctatggtgaccacagttaataataatgtatgtatactttaaaattgctaatagattgttaacattctcaccataaaaaaatgatgtgaggtgatggatatgtcaattagcttgatttactctttctacaatgtatgcctagatcaaaacatcacattgtatcccacatatatacacaattattatttgtcagttaaacataaactttattaggctgggcgtggtggctcatgcctgtaatcccagcactttgggaggctgaggtggacggatcacctaaggtcaggagtttgagaccagcctggccaacatggcgaaaccccgtctctactaaaaatacaaaaaaattagcctggcatggtggcgcgagcctgtgatcccagctactggggaggctgaggctggagaatcacttgaacctgggaggtggaggttgcggtgaactgagatcatgccattgcactgcagcctgggggccagagtgagacttcatctcaaaaataaataaactttattttatttatttttgagacagaatctcgttctgtcactcaggctagagtgcagtggctcactgcaacctctacctcctaggttcaggtgattctcctgcctcaaccttccaagtaactgggattacacaggcgcctgccaccacacctagctaatttttctatttttagtagagatgggtttcacttgctggccaggctattctcgaactcctgagctcaagtgatctgcccactttggcttcccaaagtgttgggattacaagcgtgagccaccgcacctggccagttgaaaataaactttaagatgtatgaattaaaaaaaaaaatcctatccatctggtgaggggtcataattatttttaaaaaaagtcttcgcgagatttgatgagcttcccgattggtgaacatattgaggtgctgagacggtggtgcacccaaagaaggcctagaagcttcatgcatattctgcatattcctcgcccctgccctagtcctgctgcaaccttacactgtgtacctgttccatgtcgctgctcctgagttgtatcctttataataaaccagagttattatgtttccttgagttctgtgagtcattctagcaaattatcaaacatgaagaggggttgtaggatttatagttgcttagtcagtttgaggcctagacttatgattggcctctgaagtaggaggagtctgatgtaactaaacactttaactcttgcgatctgatgttaactttaggtagataaatcttagaattgaattaaattgtagaaccgtcagctggtgtttggagaactggagaatttgctggtgttaaaaaacatataataataataataatgaattatgcttttacagcatgatttcagagacagctgaattgtctaatgcaccgagagtgactagaaggcaatagcactgtatgaatgcttattctccctcatgcctccccagccacttcaatgatctggcctaattccagtggcccacctccttgctccaacattaaggtccattgcaaatttgtaggtgtgtgtgacattttacccttaagaagcatcttttcaacaggactgatatgggtatcctgtaatctggttctatttcatgtgttttctaagttttctttaattgaagaaatgagaaagagggatatatttttgcagtcacagctcatgtaagtaactctgctaaacagtaggttgtgtgatggcctcagggccccctgtccccttgctcctttaccaaaattaacagtgtgccatggactttcatacagtttcttatttgacactcacattagccttgggaggacatttcaactagacatattatcactattttccaaatgagagaatggaatctcagaaagacagactacagtaaaagaatcaaagcatattaaacctggagggcatttgggagatcatgtggcaaaatccctccattttatgaagggaaaatgaagcctggatcaggaagtgatttgcccaaagccacatggtcactggtagaactgggttaaaaacccatttgtcttcttactttggtactttctcctttggttatatcatctaggcccccagtgcagattttcttcatagcaaatctagggtttaccatcccccgtccctgccaataccactgtctgtaaaatatagactcctcctcaagttagtttccctcctgttgaggcaaagattggaaaagtgtaattagaccaacaacactcagctttattaatgagcctttcaagatgctgcctgcttcccatgtgtgggactggaccaaatgggacagttgcccaataagagcccaaggaaagaagaatgtgagggatgagtcaatcctgggcatgtgcttactcaacctagactagcacatgtagttggtgggagaacttgaactgtgacagggaggatcaaggttacagctaaaaattagcgctgaatgtcaagttcaaaaggtgaggctagggatgaaattggaggatgaatcatgaagttgaagccaaaaggttcaagaaaaggatggattccgtatgagaaacgtggttcagaacctaggatgtgaacacttggtaagtgctactggtgcctgggattggtgcctgggatgtggtgatgggtaccatgcaggacaagacggcatctactgagtgctcccgcagatatcatctatgggaaagacacacactttagggaaataacattgtataatatcaaggaatgacatacatatggtctctggggaagctttttgaaactcagttcatctttcctttgatggggaaaaagcagaattagactgaaatcttttttagcctacttgtcattcagatagcatgcttgctgacccttttatctttgccgaaatcagaatccttcatgtctgctgcatgcgctgtgcaatgctatctggacttcagtgtgaagctgtttttcccctctgccctcttttccatctgtcctcacatttctgagtacagattaaaagccttgcactcattagctggggcaccactgcagccagccagcccatgtttactgggtgcccatggggtacctggcattgccctgggcacctgcgagagaagccaagggctctgacatcccttgccctgggttctggctcccaacggtgctgcagggcagatgaacaggcctgacaaatagtaatcaggaggatgaggggggactggaagtttggaattttgagggggctggagaggaatgaggttttggatagaattagaaagtgtgagattcagtaaacagttattttaaatgaaagaaagaacttccagcaagtgcagtttctattactgtccttgcagagtggcagacacacccattctcatgaattctgtaatggatggaatatgaaatattgccaaaataagtgacattccttggttgggagatgtattgaggctatttggttctgcctgcttatttcctgcttaaggaaacttttccatatatgtgcttaggagggtctagttgggatatgcactttcaaataacctgaatgttcagaatgggctcactataaacaccggcagttgccaacaaaagtataagatgggctagaatttccatgctttggatgaggtaaaagaggcccaaccacttctgaatgaaaagttattcctcactctgtctttgcttaataaaactgcactcactctgaacttcagaaatcaaaagcagctttgatttgttggggtggaaaacggtgggtaaatttttcctttttttaaattttgttttctcagaatatcattatgatatctgtgcaatgtggaaaaacaattatctgctctctaaagagatgaaggtttgcaactgaaaatacaatgtaaaagagagtatttctcttcctgacttgagaatgaaactaaaccatgcctatccctgaagacccagggaaaattccattccttccatgcaattcccctcttaaatatctttgtgcttccccagggcgcagcacattggtgtgagtctactggccgctcagtaaatacctgaagataaagggcatagtaatagctaatgtagtcataacagttttcactgttgagtgcctacaaggagccagctctggtaggagcagttttatggtcctcaacagtcaccatatgcattccttataatgagccagcaaaaaaggaattatatccaatttcacaaatagtcagcctgagactcgaagaggtgaagtctaaggccacacaatcagtaaatgacaggactgtaatctgattccaaagcccctgctccatgtagatatctcagtggcttctgcacaggacaggacacaagttgctgtgaccagctggtgtgcttctctttatttgcacctggacaggccaaggattgatgagtgggccggagcccctttgaaaatagcttttgaataacccatatgagaaaggaccagtaagttggcttggtttcttggttttctcattgctgtcggcttgaactttaatagaatgcacaccttcctcttttttagtttcactaaatgtcaaggttacatcagcgtgagccacttacttttcagggagggaagtgtgtaccactagtggcccagcatatcaacaaggcaaggaaagctttcccagtaaccctctctgtggcagggccagcagtgcagccctcttgggtgtctccacacatccctaggatgtgggagagggcaaagggaggtacccagtggccacttgctggctgattgataaagaatgatttttggtttctctctccttctccagcatcctgggggggtgtgtcagctcactgagagagaccctttttctcttgagatttctctgccctttctctgcacccatcccacatgcttgtttctcaggcttgagtagaaggcagatgttcacagtcagctgtaatgggccctgggcttgctctttatacatatatgtgtgcacttgtgcattcattatttattgagtgcctactctatgctggacactgtgttctaagcgagacaggaaccctgaactgtcttgggggtgggaagaccctctaggtacaaaaaaatgtgaagtgtaatgagaacacacttacacattctgccagagccccaaagagtcattcacctgtcggggagtgaaagtagtgatgctggtggggttggagaagtcttcatagctcaggtgcacatttaaactgaatcttgaaagagaagtaggatttgataggcaaacagggcaggaggatggagcgttctgggcagatgaatgcctatgcaaaggcctggataaacgtggttttcagagaagaaactgggaaatactcattctctgtttatgtaaatgtgatgcctcctttaagtccagcacgagtcccactttctctgagaggctgatctacactattccaggtaaccccttgctctccttttaaaataatcctgatgttggtcaaaggattcaaaatttcagtttagataggaggaataagttcaagagatctattgtataacacagtgactgtagttaataacaacatactgcactgtatacttcaaagttgctgagcgagtagatttttaagtattctcaccacaagaaaacgataagtgtgcaagatgatgtacgtgttaattagactgatttaacccatccacaaaataagcatatttcaaaacatgttatacaccaaaaataaatacattttaaatttgccagttgaaaatttttaaaatatatataaaaaaatctgtagcattatctgtctatacttaatcaactaggccttgtgttgttacttaactctccaatggatatctattttttccccttaactatactggtagcctttggaaagcacagagcatattctatatatattctgttcccctactatgacaagcatagaacagagtacttaaaaatatttaacatgtatctagaatgagccagaaaaagactttagagatttttcagagaactgccctcatttgacaaacaagaggctcagaaaggggaaatgaactttaatgaaatcatttggtggcacaggtgggatcagaactcaggtcttctgattctcagttagtggcctgctggtttcatcagctgcttccctgtttgttgtaggcagctggatagatggacatcatgggtgtgtgatgcatgtcaattgcagccttgtctcaatgccacccactcttcagctatttgctaaacctcttcatctctctccctgttgcctccacaccatcttgggggaggcaagtttgtattttcaaaagtggagactcctcagcaatggactatctcctaccagagccttctgaggacacctttcacagagcagttggcatttgtcgggggtgaggaggaagggagtggagaggatgtaatctcctgctttcacttttaattcttcaggaggaaaggtcttccccccatctctgatgagtgttttcagagtaataatcacctgtggagtaggaggggtatcccacacatttttaatgaacccagattaatgagatgtcaccaagacgatttttttttttactttaaaatgaagtttcttttgtctcagagcctttgattcagaagatctttatgaacagagatggctccatgtgagtgatgcccagaaatgccttgatcacatacagtggctcatgtgggtcctgggctaagctgtcactttttacagctatgcctcaggaagtgggcagtccttctcctattctaaaaatcaaaataggataataatgatatttccttacatttgtaaatagcaacttgcaaagtactttgagtttgataaagcactttaaatgcttcattaatttttttaaagatgctatcactgattttacttcatgtccatcctatttatttatcaaatatttattgagtgcctattatgattctaaacattaggaacacagcagtgaaaaaagacagacgatgcccctgttattgcagaactttcttttttaaaaataaaagacttttgcagaactttttttttttaaagacttaaaaaaatttttttaaggacggggtctcactgtcacctatgctggaatgcagtggcatgatcatagttcactgcagccttgaacacttgggctcaagcaatcttcccacctcagtcccttgagtagctgagactacaggtgcatgccaccacacccagctaattttttgttgttgttgtttggtagagacaaggtcttgctatgttacctaggctggtcttgaactcctgggctcaagtgatccctgccttagcctccaaaatttctgggattataggtgtaagccactgtgccagacctttaaatactttttattttgaaataattttgatctgtagaagagttaagatagtacaggaagtttgcatataactttcatccatcttcccttaactttttttttttattgaaactaagaagttaacattggcacaacactatgaactaaattagagactatgttcagtttctactactttttctactactgtcctttttctgttgcaggatataatccaggatctcacatacaattagttgtcatctctattcagtctcctccaatctgtgatagatcctcagtctttccttgcttttcacgatcttcacacttttgacgggtacttatcagatattttgtagaatgtccctcagtttatgtttgtctgatgctctcttacaattattctgggcttatggatttttggatacatatcacaggggaaagtgcccttctcttcgcatcagaggtacccaatatccacaagacgtccctggtgcagttagctttgatcacttggcccaggtggtgtctgccaggttccttctctgtgaagatattattttccatttgcttttctttggaaggaagttactaagtcctgcccaccacactgaagaggaggggaattagcagagcttgcttttaagtaaaaggagatagaaaataatggagtaaataaacatgaaaaattatcaatgaatgatcagttttgagcagagaatcaaaactaagtgatgtgattgtgagtgactgggtggttagggacagtttcagctgatatccaaataataaggagttggccatgaaaagaccagggggaggagcatgctagagagagggaacagcttccagtgcaggagcaaacttggcatgatcagaccatgcctctccccttttcaaaaccctccagtgactcccgttccaccagagggaaagccacagtcccaacactggcccacacaatctgcacaatctgtcccccatttgacctctagccccaccctacaccttgctattcctcaaacacaccaagcacactccacacttaggccttggtgctggcagctccttatggagaaactgttctcctttttacgctcatggtcatctccctcacttctctaaggttttattcaatgtcatcttttcagatgcttaaacttttttgtgtgtgtgtgtgtatcaccacacacacatgcacacacacaaacaaacacacagtgagtgagtaggtgccccagtccctagaagtattggcacgtgggttagagggaagcccactgcatatggacttttcatatgggcttggaaactttcttaagctaactgggcatgcttgaaaagccaataggcaactgtgactctttagcacccatctccttaaggttgtttttttctgacagttatcactgccaagttgacaagcaatcaattcctttgctccacgctttagacactgcctaaatttcaggtattagcaaattcttctgctccctcttcatttgctggtgactaaagaggcatatgcatcatgcctcctaccagctggcatgagttatatgatatcatatagtttctactaaacctcatacatctctgctttctctaatgaggtggatgtggatattgaggttgcatttcttttcagagaaaataaaaggcaagtcaatccatgtggtcagataaagggaaataagtcttgaataggaatctctcctaaatggccaatgaatcagcatagaaaatgcatcagtgaggcctaagttagtaccacaataattctcattttacagatgagtaaactgaggcagggagtggtaaataactttcctaaggctagtaccaggagcagagccaagagtcaagtctaagcaatctggatgtacccacaatcctctagcagtggctccagtgtggaggactcctattgtagacagtgccttctcctagcacaacatcagcaaagaaagactgtaaatatctccttactagaatggaagctccctgagggcaagaattatgaattactcataattgaacctagagattggcaaaataattcacacagtaggaactcaaataggtatctgtgaggaattaatattattcattatacagagttttggattattcattattttggattagtcattcttctgtttctttgatgaggaaggcatcagagacactggtcagactgtaatgtaggaatctattttccttagttggattccttttctacactttttgggcattatttcctcatagaaatgttttgtaaatgtggccagaaaatcaacagggacttaagggaggttaaaggaattaacatgtgtttgcaataaagcgagtcatgctatagctaagaaagtagtggttttgtaaattaaaccctgaccccagctctgaactcaagcaaacattctttttcctttagaaaagaaatcaaatacatgccagtatgaaaaaaatgcatcttccatattaaaggtccactgtaactaaacttttaattaaaatgagcacaaaaattaaataatataacctgcaatgttgatgaagcttagcctctgtgcaagaaagctatgtgtttctaacctgttgacatttttcaaaacattaataatgggaaaactatcccagtggggatatctcagacttaaatattcaaaaggtttttggaaagtgtcctacatctgggactgttaaaaagataagtcaacacagggataaaaaaaaaaaaaagtgcttgggttgttttagtaccttggaaaggaccgatactaaatagagttgttatagaccaatctcctttgcccggataagacggtccctgactgggtgtggatgacagggagctagaaagattggctgaacatgatggtgcacacctaacaggctccatatcaagaaagggaaatggggccaggcacagtggcttatgcctgtaatcccagcactttgggaggccaaggtgggtagatcatgaggtcaagagatggagaccatcgtggccaacatggtgaaaccccatctctactaaaaatacaaaaattagctgggcatggtggcatgtgcctgtagtttcagctactctggaggctgaggcaggagaatcacttgaacccgggaggtggaggttgcagtgagccgagattgtaccactgcactccagcctggcgacaggacgagactccgtctcaagaaaaaaagaaagggaaatggattctggtcaatgagtaatctggaacaatataaacaattctttttgctctgagttctagaaactgacagggagacaagagatgtggacatatctgatggacaattatgttagaaaacttcctttggtggtggggggagtccttgttttaactattctgtccctatgttagaccacatacctaaagtccgcatttttaaaatctatgacatctcatcagcctactactggaaaagacacagaggaaaggggctggtaaaaaaaaaaaaaaaaaaaagatttatttatttatttattttgagacagggtctcactctgttgccgaggctggagtatggtggcaagatcttggcttgttacaacctccacctcctggattcaagcaattcttgtgcctcagcctcccgagtagctgggattacagacacccaccaccacaccgggctaattgtatttttagtagagacagggtttcaacatgttggccaggctggtctcgaactcctggcctcaagtgatttgcctgcctcagcctcccaaagtgctagcactctgtgccagatccagtgctaaggttatctcatactaactcattttatcccaacaacagccctttgaggttgacatcattattattattattaccattcttctcactcaggaagagcctagataacttatcagaaggcacacagtaggtggtagagctgtcattcaaatgtgcttgcttgaagctaatgttaacgcctgagcaactcatctgagcccaccctgtgatttttacattgactggcagaaacgaaggagagggagaacaatgttagcagccaggaagatgagtcacatggctgtgatgtgccactgagtccctgtgatgaggaagactgttgtgacactcaattacaagatgctaaattctttgagtgtacattatggattgcttatagttattctttctattaatgggtgacactcctgtttgtctgggatgcttttatcctatttcagttatgttcatgcttctctttcaagatccggcttatgtcagaaagccttctccatccccctaatttgagtcggatgtgtcaacagcacttgagcttgtgaattttgtcaggctgatctgaatagaactgtctatcttcccactgtggcagacatcttttagggtgtctgcataaccgacagtgtctgccttcaccagataactgttctccccaccatacaggcaggtaaccaagacctatttatctacctcatcccacatggatagctgattgggtcagagaggacatcagatcctctcggggaaaaccaaatttcttctttggagaatgtggaattgggataaagagccagacagctagtcagtacaagaaggtcttgcgccaaaggaacataaacttgggagctgaagtgggaccatttctgccctctatatacacagaaaataaaaaataaaaaaaagacagctcatggggagaattgagaataaggccgtcatgcagagatgggcaatggagtaggagtgagtccctggcttataaccttgtttcagttttggcttccagttccttcatttgtccagttacccttgagttctatgacatatcccaaaggtattctagtaaatcccccttttagtttaaccccatttgagtgcgtttctgttacttgccccccaaagcactttacctaagatgccgtcaggaactagagcccccagaggacagtggcaggatttgttcttgggtgcagccctaaggtagcacagttcctggcttagttatatgaatttttgttgaattttactaacttaatatagcttttctatgagatagcaataacactacctggtcctccccaaattgccacacgctccagggaattagatgaattaaagccaagggctggctggctccattgaaagccacgcttcgcctcactgttgttccgtctcgtttccagtttgagaaggcagggaggctgggaagctgaaaagcactcagaagacagggaacagcaggagaaagtgacaagcgagacaggatttgaaaggggcttgttttgagtgctttggaatcaacttgttctttaattaagggggaaatatcaccctccagctagtaaagacacccctaagaaaattaaaataatgtaaatcaagctaaatgaatactccagaagcggcactagagctttgtaggattgagtgtttggatgcccctgaggttttaaaagcaaagcttgcaactgctttttggagcagaaacattctctcttttgtttgatggcaaaggaggctaaatgccgacaccaataggattcacggaggagttggaggtgacagaatcttcttactgtttcggctctctaaagaccagaattgaaacaaaacctaagtagatgatgctgataaattcctggggttgcttcctaggggtgttcaatgcaaagaaatcatttaacttgtaattaattctacaaagcaaaatggttcaaggggaacctagagtttctagtaaaataccttattaatcacaggggcgttttacctgggaggtgcaaaatgactgaggtgtgatggggtttgtgtgtgtgaaagctactagtatggtagtggcaggagcaggaggttcaatattgcgacaagaaaaggtcgcagatccaagtgagcagaacaatctgagctttactttttcatcaaatgtcttaatttcccaagattttaccttaaaggaggtatgaggatggttacaaagtgtgtactcaatctttggttggggggggggggttccaatgtaacacaaataatttattacacatcaatgtttctgactctcaagatagcatcatgactccttaatcaatggtttatacgtgatggcaaacttgtgcaagaagattttacttccataggcctcttggtgctggaagagctactctagtcctttcatttctggatgaaggaaaagagatctagagagattaagtggcttgccaaaggtcacctagtcgtagggtgagcatatgattcattgtgcaaactggaggacttttgaaggtgaaaggatgtactataatattacagttataccaggacttaactggtgtcagactggactgttcgggcaaggcagggcaggtgatcatcctatttagacagctcagggctttgcttcaaactcacaaggaatgaggaatattctatttgcgggtcttctttgcaataataaactgccatctgggggcagggaagggcaccacctggaggccaggaatgggagggcgattccttgcaggacctcaggctgatgggttttctccacaattaagtgtggttagtaggggcttgactgtcttctgcaggcctgagtgaatgtcttagtccattcatcagaatatctgagatggggtaatttataaagagcagaaatttatttttcaccgttctggaggatggggagtccaagatcaacacaccagcaggctcagttctctggtggaggctgcatcctctggaggggaggaatgctgtgtcatcccatggcggaaggcaaaagggaaagaaggaggaggctttttctcctggcagccttacagcaggatgccttgacactgataagaaaacagcattagaagggcccttaacccatcttcttagaataagggtttcaggaaccaactcacaactgctcatgtaatttttaagaatttcaccttctgcatgggtgctactctggattcttgttagatatggatggaggatagaaatgctgaccctgtatatatgcaatgtggaatattacacagccataaaaaagaacagaatcatgtcttttgcagtaacatggatgcagctggaggccattatcctaagtgaattaatgtaggaacagaaaatcaaatactgcctgttctcactcataagtgggagctaaacgttgggtactcaatggcaccgacagacactgaggactactggaggggcagggagagagggaagcaagcgttgaagaactgactgatgggtactatgctcagtacctgggtgatgggatcatctgtatcccaaacctcagcatcgcgagatatacccaagcaacaaacacgaacatgtaccccccaccccgaatctaaaataaaagttgaaattatttggaaaaaaatgtgaaccacagatgatgcagcttgaagaagcatgtcattgctaataaaaacaaccatttttgagcactcattctgtgcaaacaactattctgagcactttttatacattgatccccttaatccataaaactactctgcaaagtgaaactgttctgtctcctgattgtgctgatggtcatccaaatctatatacctgttaaacttcagagaactttatgccaaaataaaaaagttaattctactgtataacttaaaaaacaaagtaaaaaaaaaaagactatatactgtataagtccacggattgaaatccaggaaaggcaaaactctagtgattgcaaatcagtgattgccggggctagggtaggagggaaggactacagaagaacacagaaactttttgggttgatggaagcgttctagaccattttggtcatggttacacaactatgtatttgtgaaaaagcatcatattgtacagtttaaattcttaaattttttttgtatgcaaaccatacctcaacaaaactgggggaaaccaccctgtagaatggacatcactcatatttgtcccattaatgaggaaattggggcacaaggaggttgaataaattgcctagggtcacagctgatagagccaggattcaaacacaggaatgaataattccatcaattttcacttccacaattaacagctgctcatgcaagtaggtcatggcccttaacctgggtcatgggaacacattagccctagagaggcagctgcaacaggtagaaaatgcttgacccccacagaggactttacagaaacagcagctgttccgggatgaccatttgagtccacacacaattagtctttcccaaagcagacacaattacttgatttgaaaaactggtgccaggatgctaagtcctgatgcagatatctggtggcccctgggccttcccctttttcctggctgggagtgtgatttaaaacctcctggctaagctcattttgccaaatagctcctgcaggattcatttccaaggctgagtccagaaatttctagctcagcaaatagatccaaagcaagatgacgaattcacccaagctacctctgagactaaggaatatggtttcttgtgctttgcagaggcaaacagatgtgtttatacacaaatttacacacataaaatgccttgcttgttataaagaagagagaaaaaatgtaactgtacatctgcatgtacagtagcttccatctgggaactgtaacttcccagtagctgtccatctgggaggagaaggtgaatgaaggaatgaaggtcctccgcaggaacacagaatgatgctgtgtcatatttcacaccgctgctgtactacttggagaaataggctcctgtctcactttacagctagaaacagtgcagactgttcttaaggctgatgcagaattgagaggaactggaagatcatctcaggtaacacaatcaggcacttatgattagaagaatggacttacccaggatcaagcagctacttagtggcagagccagagaggtaaggtgactgtctaaggtcactcagtgcatagctggagtcagagacctgggttctcttccctggaccaaccatgcaactgaaagcaggttctttaacctctcgaggtttctgttccttgaatataaaatggtgctaataagtgctagctcaaaagcttattgtgaggactgggtgtgataaggccctaagcacaatgcctgagacacagtacatgctcaataaattacagctgatggtagaagtcattttagttcaccgtggttatgctaatgtatcttatcttcagtttgggctagatgagttctaaggtgaaccttagaacttagttattggctagccaataactaactgacttgtacagcactttatggcttaaaaagccctatcacagaagagttttctttgcattgcacaattaccctataatatatatatagaaccagcacaattagctccatctcccagtttaagagactcaaaaagccaaagcagtttactgaattctgccttttccaagatcacacagccaataagtggcagagaggagtgctgaagtcagatcttctaagtcaaaatgttgccttctgtctggtggcccaagtgtccaactcttaggccattgtccttcccttagtgtgtttgtccctgcttccctacagccccccttccaggccaagccaaccattgctcttggagtgtgcctctcaccagcagatccaatgaataatcatgacagtaaccctactgttgcccttttactgcagagatggggatagatttatagaggctgactgtggctggtatttgggaatggataatcaccttcacttactatatcctaggctgcttcggctaaatatttactgcccagaattctgccctttccaaccaattctgaatatgagcatggcacaggcaactaagtggcataattcatttggggcaaccataaatctaaggcttccaccagaaatgatgcaaaaaattaatggaacatgaaatcaagtaaatggaattgagtacagtaattagttcatattttaatcctcaggtctgtttattatctgtcaactggcgagcaattaagttggcaccattgaaatgattagctttgtttcagcaaaagtttatcgatatgtcagtgcaaatggatccggtggttttaaatggccttattttgaattgtagagcagcacatccatggagcagctagacatcgaatgatttaatttagcaatattatctggattacttatatttaatattactgaactgttctggagggttatgggggaatgtgggcgggggagatttaaactgcacaaaagcattgcttctgttcttaggttcttaatgcaatagtatgattgccttttcatattgagaccaaggaagaacatttaagacactatattttagtcttccaatctttaattctcacatttatctcaatcaggcactattatggctcgctctcacattggtggtcttttctcaggggtgatttggtgatttctagatccacttccttgtggatgctcatcatggcttatgttttgtgaaataatctcccaatgtctttgctgttttgaggctgactctatagatgcccttgcgatggggctgtgctcacaaatgcaggaaatgtgattctcaggctctatttgctctatgaggtgactaaaccaggtgacctaagaaggttttttgaatcttgggatttgacagaattctaaattttatttaaaaagttaaaaatccccaattaagagtcaggaaacttgggttctggtcctaattctgccgctaaatctctgtgaccttgggcaggtctcttgccctttctggcatttgatttttcctttgtacacacagggggtatgctggaagagatggcctcaaaagttcctcctctgacactgtcactttagatggacacttggagtagacttgtcctttccaagtccaggtctatgtctggaagtgagagatgtgacctttcgtggaacctctacaaattttcattggccactgatagtatcagagtcccaacgaatataggtcattcttatttaacacctctttttcaaattgattttattcctgcagcgttggaaatgagttaaaaaacacagctagttcacggaaatgttgtgagcggtactcatgcctgtaactgcagtgtcactggttactaaataaacgaaggcctcattcaacacttgtaaaatgataatagccatggtctccatggtgacaggtctgaggcagaaccctgatcaaattccagttaatgcctgtctttaatattgtcttttgtaatgtaacaccttcctcctttcttccgatgaagcatcagcagggagatcagagtcaagtggaggaggatggtggctgtcatatgccatcctgggggtccaggccagagttatgatgcagattaggctggagtcaatgggataatgagttgaccgcaggaggctgtcttctaatgcaatgccctctctcttaggctgcactagtgactatccaatactggcaattcaggaactgctgacttgattgggctgtgctttcccagaagtaattataaaaatgtccagagggagaacttcctctccttagatcagagtcatcatatgcttgctggtattgctgtaatgtgccctaccaccatctgagcttctgcctctgctttgcttctcgaaggccagtttgctcactctggtgggactggctcttagaatctagaaatttgatgtctagcattggcaaagctccttagtctgatcctaggagtaattccagggctgaaatgaggaatctaaatgaatttttctggtacacaggttctcaattgttccattatttctcccaggtactccgaatttacttaccttgtatttgtgaataatttaacataaaaaattctagaacctctgttaatattgacaactttattaggtttgccattatgactatacaatttaattcatgatctattgggtataatctaggtactttgaaagctacattcttaaattatcttcatttactcatttaatctctactcagcaatacgtaccctgtgcccattatgtgtatggggagatatttaaaaactacaacatactctgtgactgtagggagttaacagtctgattggaaagacaggatcctctactatactgtaggctccttacaggtaggcactatggcctatcagtctttgaatttccctaccaagctagggcccagagcagatgcgtaatcattcgtattgggtttatggataaattgtgggctatattaggcagtgttatgaatcagaagacccgaactaagtccaatcttggttatttattgcctggatggtcttgggcctttgtttccccaagaaggtggtaacattgagagcaaccgccttgaggtttatgatcaaatgggagaatttctgtctctgtgctttggaatttattcagagtaaaaaccaaagtccatacaaagtgcacatagagaggacccacgtggtctgcagcagcctctggccctgctctgacctctccgacctccttccccatcactcacacatgtgctcatgctgcttccgctcttccttgcatgctcacagctccctcccacttcaaaatcatggtactggcgattgcctctgcctggaatgtccttccccagacatctccctggcaacctcacaaatgtcatcttctcactgaggcctatactggccacactatttaaacttgtagctcactccttccactcctcattctctgatctctcttgttttgctctagttctctctccatagcatttatcatattctaaatttacatgtaaatttactcatttattatgtttattatttattatctgtctccccccgctagactataagcaccttacaggtagacatttttatttgttttattcactgtagcacataatagacaatcaatatttgttaactggatgaatgaatgaaggtaaaccacaaagcatgtgaacagtggccaagtgttggcagtgagattctgcagccacctatgggcatgactgggtgagctctagattgtgctgcacagtaactaactcaagtctgtgccttgtccttccagtggctcttaaatccctccagggtagcgcttaattgttcaatccttttgtgtcctttaccacatttgggatagggctaggtggggtgccttctaaatacattttgaatttctgaaagcatatttctttcccagagaaattccagaacatgtcttagtagtaactgcaaactgaaccactcttcctcttttacagtttctaatggaatttaatgctttgggtagccttcatataaacactccatcttcaagttaaatggggctgtatatttctgtatagtgaatggaggcaacatactttagaatttcagggaaaaaaatgcctataagatttttgttcctgggacacaaatggttgactgagttgttgattcagtggtttaatgactcattccacaaacaccacttaagcactgactgtatgtcaggcactgtgctaggtgcatggcatgcaaagatgaataggtcttgtccttaagaggtttaccaaggtcatttattccctcattcagtaaatatttattgactatcctcaagtccagacaatgtatgaggtgttgggaacacagcaatgatcaatataaaattcccatcaacaaaggactatggttccaatagaagtgagattaaacagttacaaaacccacagtgatgggcaacataatagattggggtcagctaaaaaggccaggtagtaaatattttggcttctgcaagctgcatgtggtcggtcagtttctctctttttaatagcatcctttaaaaatgtaaaccattcttagctcctaggctggacttggtccacagggtatggtttgtaaacccctgtaatagatgaatacacaggatcctctggaagtcaaaaggaggcagcaccttcctgtctgggaggagagaaaggggcttgggaagctatgatggggaactgtggtggatgggggaagggagatggggctggcattcagagtagagggagcagcttcaccatggcatataagtagcacttccatatgtattgtccatgtacctgtccttatacatcccaatcctcatttcctctcaatctccaattgtgtcaatggagcatctctaccaggaggtcgtggcagagcagcaaagtgctaattacattgcctgagcactcctcacaagccattcattgcctaatggggccctggctctcaaggatgttctcctcagcacttttcataccctagcacacttcaggacaatttgatgttagttgcttattcctacaaatttgtgttgctttagtgaaaccagcctctcaaggatgcaaataattgattcctggaagaggacaaggcctgcattttctgttgttttgtttcagttgttggttctgagataattgttttctcttttctgattcagagccactgagagagagagagaaagcaagagagaaagccccatattttacatatgactttaattctccccttttaatgaaacacatcctatctatatcaccatagcaacagctatggacttttccctctctcagatgtgttttgagcaggatcagagattccagaggctgagagctagcaaggtcaaggtgtttctatcttgctgtcagagggagcagcaagtgggtcaggttgcacagctgctcacccattctttgcttaatgctatctagtgagagctatttcataatccccttctggaataagcttcaaatataatccacattatgtggtattatcaatatacatccctcaatagactttacacatctgtgggcagaagctgcactctggcccatgcctagctcggagcccaccacatggcagaagcacaagagcatgtgaagagtggatgaaattaacaggaggaactggctatagatcttgcatgaagtggctggtacaattctccgtgtacccttctgcccccttgaaaagaagaacttaaggaaggatttttaaatgaacttgtctaatgtatcccaaatcaggaagattcttcttgtccagcccccactactgcaatggaatctaaggcatgtttcttttcaaatattattttttccctggctaatgtattttcttcttttcataaatatcctactttatactggacattaatctaaccatttagacatgattagcaagctaagggtcttacttattaaaaacagttcatttttccttcttaaagaaatggagacatttgaatccctgaatgtgctcatttatcaccaatccccaacaaggaatccaggagttctctgtgtaggacatgagtaatttttataaaaatgcagttgctgactatgtcatacatccatgcagctttataaaacaaagcaaatgattaccatcaattacaataacctcactagacaagactgcaattaatctatagctcttcagataacgactgttgcactgtgccaaggaaaatgcctggcattaattgacttatcacgatcagcagtgatagatagggcagatggcaatgtgatcattcactgtcaacaaaataaacacatgctttcttgctagaagtgtctacttgggtcctctcaaaggatagccaaaaatagaggccaaaggtggctttgaaggtagcacaaaataaaaattaagttaaccagattcgcgcaatctacccacataacaaacctgcatgtgtacactttaatctataataaaagttgaaattcattttttaaaaagttaaccttcagggtgagatatgttgacttttactgaggctaatcctcagtagaatacaattgaaggaaatttctataagaaaatcatggattggtgcagtggctcacgcctgtaatctcagcacttcgggaggccgaggtgggcagatcacttgaggtcaggaattcaagaccagcctggccaacatagtgaaacctcacctgtactgaaaaaaattagccaggtgtggtggtgcacacctgtaatcccagctactagagaggctgaggtaggagaatcgcttgaacccaggaggtggaggttgcagtgaaccgagatcatggcactgcacttcagcctgggtgacacagcgagactccatctcaaaaaaaaaaaaaaaattatggattgtatagaatttcagcatcagaagatacattaaaactgacagtttcccctgctcattcgaatgtgagtcacctttatggagtcaccaaattctgttcagtgcttaataactccagtaatggggctgagtgcagtggatcacacctataatcctagcactttgtgggggggccaagacaaaagaattgattgagcccaggagttagaggttacagtgaactgtgatggtgctaccactgtacttcagcctgggtaacagagtaagaccctttctctctaaataaataaataaataaataaaataattccagtaatatgaagtcacaattttcagaggcaaactcatttcatcactgtatcgttttcatcgttagaacacatatgcagctgaattccatctttttgtagctaccacccattggccataggtgtcttcccttatgctacacagaagatgccaaactcttcttgcttgctgaaatccgtaaatgggatctcaaaagtcaactgcttatcgcactactttgcatatagcattgtttcggggactctgaaattctggtctcttgcacctaaacccataccagttcgtctatagacccctgacattgagaggcttggaaagaaatgtgatacgatgactgcatctacccagggcaaggtagattatacctatgctgaggccagtgctcaagcctacattggagcagtggatgtgtgtgtgtgaccaccctacttgggaagctgttctccaagtctcattagtctagatagcatcccagccttgccatttccaggggacaattaccaatgtgtgtgccttcccccctttttagcagtgtgattttgttgattaagtcccctttgtttagaaaactgggataattcaggcggagtttcacctaaaattgtcacagtggtcgctaaccaaaatctcttggggaaagttttacaaatgtacaaacctggatcctatatcctgagactgattcagttggttttgggaaggactgagaggaaaatattttgacaaggcttcccagttcattgtgatttgcaaccctgcttacatgctttcttcactcattgctttcttcactgggaacacataataatgtaccattgtggaagtgcttcacaaacctaatcgtcagactctcctgggaacttttaaaatgcaaattctttggtgcacctgatacctgtggtctggtgtaggtctaggaaaattcatacactaagagatcaaattactatatgtttcccttaaggattttggaagcactcatttactctaaaattgtggttcacgtataagttacaaagcacccttatcatatactgaagaaacaagtgtcactaaagaataatacaatgtaaagattttagcctagtaaacatctacattttatcaattattcatttaacaaatatttctactctgaagcagtgttgtgataggtgctggaatatgacagaatatgggggagaaaaagaaataacagcaaacaaaaaaatgagcaagtaagtcaacagataaaataattacaaaccttaaaataacttaagaggaagaattcatctaattttgaatattctctaattcagaccggcagtacccagttatgctcaaattgtgactttctgtcctgctttcattacatttcttgttgtactctagttcagaatctgcaacttgggagcctggcattacaatgcctttggcagacatccctaatcaatcctagtattttttttccctacagatccaggagggagacccatactacagctcaaccctattgtttatagagtcatgattaacagatcacagataaaatgctagatgaaatcatgcagcttctctagcacacactgccctgacatgcctcggggcttttgctcgcactagccctcatttcctgctttgtcattgttgtttatcaatcattgagtactttcagtgtttttacatctggaatcccacttaatttttaaaatggaggtgtctaaactgtgccttagaaggctcaagtaacatcccaagatcacacagtgtgtatcaaagcaagactacaaaactcaggtcactggactccaaagctgatggtcttaaaattgttcatcattgcctctctttacagcccagttcaaggggcaccttctctgtgaagcttctcctgaccccttcaagcaaaatttaccacttcttcctttgagtttgccagggcctttgtacatccccattacagcatgacattatactttaatgacttgaatgtagcactctttgagctcctctgtggtaggagccctttttttaaatctctgtatccctggtaactagctgagtgcctaggcaggctcttagtgacacattttggatgcacattaaaatctggctgctggactcattaagattgtgggtctgtttcttagtgcttggccttaacacactaaaaataaggccagatttatacatgatctttaaaaaaataaaaacaccacatgcaatacatatttttgtaatttcaaagccttcctaacatcagttattgaggactcttaagcagaaacctagtcacagggcatttagcctgtaaggacccctgatctctagttcataaacaccctccagtataacgggggtaaaacagatcaaattacctacaccctacttgtgaagtgtcacaccacagatgacaactgtttaaactgtagctcttgtcctataaatgaaactgtggttgggctctctgctgtggcctgagttctgtctgggttgatggtggcacacagtgacgtttccattttgcagaaactcaggaaaactattgagttgcctgacacttatttcacagtatgttatagttttatgcaaatatgactcattatattcaaaagaaaagttatggaatctgtgctatcatatgtgacacgtgagaggctgatcgcccagataggtgtaagtaaagatgtattatatatataaggtgaggatttggggttgaaataatgctctagaaatatcactggacatgagtctcaagagagctgcaacattgtctcagaaggaaagagctagtttcattgtagccttccctggaaaatactagaagcttgttattgacttcgatgtcaatttgcaaaagacagatggagaaagaaggcatgggccttctcatttcatagattagagcgaatccctttgttatgttatcccatcttggacacaaacaggcacccaatcttataagttgacatttaaccttagtactttgacagactaacatacctccccagagaaggcctgtccattgaggaggtgctccgacccttggctgtcctcactcccaaagtgtagtcggatctcctccagccggtggctgtatgtcatgggccctccagatatgttgaccaagtgctccttgtccaggcgaagggatacgtgtcttccagtgttgtacatggtcccactgacctgcaaggcaattagcaacaggtcaagcaaggccctccttcttctatgcctccccaaacccagcatggtgcttggatcaacaccttttgcttcctcttgatgggaagatgggctaaatccacatgtggagtagggcgtggcagctgccccagagggtatatgtgggatctatggtaatttctgtgaggcataaaccacatgatggcttaggaatttgaggtaagaacttgaaggagacttttcatcatttgtgattaatattttgtgcattgtattttataaaaaatgaatttgtccttcttactataaggatttggaatggaaagatactgcaagagttctaaatctcagctgtgagaaattggagaaagcagttagcaaggggtgagatattaagaaggccaaatgagacagggaagagaaaatgagtgactagaagcagacgctcatgggagatggaaagcctaggtctgaattctcaagcgtcctatctggtgtgtcctgccctgcaaccagacattgcacagaatcctcatagcttgtgggcctcaagtggtaaactaaagggattcactcaaacttccaatttcatagattcctagacttactccttattcctgattccatcttgctccagccccttcaaactgctaacatgactgcttggcattccttttccttcttttcttgctgggacttgatgttcagcttcattttcctgactgtgacctcaacaacaattgattctagaacactcattcccatctgaaactctactttcttactctcttgggttgacttagctctgggagtaggatctagagcttagggagactttgaatgagtctggaaggagtgtttctgggttacaggaggctgaactatttggattttcttcctgcttactctgactttgggccaagccttcagccctagtgattcctgaagggcttcctgtaccttctgacaccttcattagatgtggttttcatatatgtgctctatagcactatcttttacctgcctcttttccacctttctgacactggtgttgtgaatgattagctcttgagttgttcactgtggcagagaccataatgctcaccaaatattccagtgactcattttgtttcctgccaccttactgtagaatggagcccatgtgactgataggggccatgggttgggaggggtcatgacaagtgtcacttccaggttgaaatagtggattccccagactcacctttccctggtacatcgaccaatggcattatatggaaatggcaatgtggtgcagcgactgcatggagctcatgtcagcctaggcccctagagattatgtgcagtttacaaaaatgacaggaattcttcccctccctataactacactcccaacaatgtaattttgtaactgctgtcatctagataagaggctatttctctacgtcgagtctgggctggccttgtcacttactttggccaacagcatgtgctgcacacaacatgctagtcctgagagtagaccttgagggcatgcgtgttttcttcacttcttcgtggagccgtgaaactaccatgcaaatgagcctgggctagcctgctggaggatggggccacagtgaggagagccatcccaggagaggccgtctagacgggctactctgtggctgatccactagctgactggcccagctgagatcagcttagcctggcccaggtcagaaatgtccactgacccataggcttggagctaaatgattatttaagtctctaaattttggggtggtttgttatgcagcaaaagggaactgatagacactaagtcagtcatcttctttctcctgtgaaatctggaactatcaacagaaactctccgttgagttcctgaactgcaaggtcgcctgagtgccaaccatactgttaagcagagaaagtcagatcagagagagaggactgaggcagatgtcccaacattgacagaggagaccacacactggggaacgggggagggaatggggagaataactacttcgcttcagatatctttgtgtctcttcgttctagttccttcaagaggcctgaactgtactttctaatattctacaccttaccaatacatttttaaacctcaagttatctattccttgcaaccaaatgatccatgccaatgacttcactcctgttctccagcctcaaataaatgtatatttagttagtgtgagataatcagaacttttcatttcccataacttccttttcagtacaatagctcaagacagatttgtgttagacgtgacttccatctctaaatataacctattttttctaattattaagataatacataggcattattatatggttcgaaagatatgggacagcaaatcgaccacaatttcacaattaaacaggaatcaccactaatattttggcatatatataattttcacactcatacttatagacccataatttaatgagattttatatatgtgcattataaatatataatatagacttttcacttgcatatatgtatattatatatgactttttatgttattctaacatatagatatttccatgtcattaactattctttagcaatatcactttgaaatatctacatcatatttccttgtaaaaatgtttagctgattgttgaatctttacagccctttcactttttcattattgtaaaaaaaatctgtaataaacatcctcatggataaatcttttcacgaatccagagatatttcattatgcaaattccaggtcaaatagtgtacacattattacagcatttactatgtattgctgcatccatctgctatggggagtagatcccacagagcagggctggatctctgtaattcccttcaaatgacattaagcacagaaccatgggattcaatctagtgacattctgtggtataaaaggcaacaaaaaacattgctccaagttcctatgacatgcatgctttgtgccattgggcaagtatcttgggcttcctaacacttctagaaatcctttcatctatgtctgtctaatgttctcaagaaaattattgcccattgaatcaaggcactgactacattttatgcttgtgtgaattttcccagtacttgggaaacacactggcacaagtaggtggaaaaatcaggggccctggagtcaaaagattctcagtctgcctcttgcgacctagggtagtttactgaatttcttgaagcttcagttttcttaaccatagaggtaacagaatttcctccatgaaaatggcagacaaaaaagctataaggcatattgaaacaaatagcaaaatgacaaagtcccttcttatcagtaattactttaaatgtaaatggattccacttgtatgctatatctaaagtagccaaaatcatagaaacagaaagtagaatcgtgattgccagggactgagggagggaggaagagagagttagtatttaatgagtataaagtttcagttttgcaaaataaaaagagttctggaaacagatggtggtgatggttgtacaacaatatgaatgtacttaacaccattgaattgtacacttaaaatggttaagatggtaaattgtatgtcatatgtattttacaacaataaaaagttggtaaaaattgccctcacgaggttgtgataattaactaatatatgtgatggtcacacgtgttcattctcttccttcccttactcttggctattatggcatgggtgcctaggtgatattgaaggattctcgttgatctttcttccccatgtcttccccaattcccagagcctggtggaatataatgttgcttgctaaatgtcataatgaagaactggagctaacttctgccttgtgatgattcactggcctctcattttggattttaaggtgctagacatgaggagaatgcaagatcatattgaaggccatgaagcaaaccccaaaccagaagcaggaatacaccaatgtgccttctagttcttcgatctcacttccagaccccttctgcatacatggctctgtcttcattcattcattcgcttggccatttactcagaacaaaacattcaatgcacctaacagtgtgctaggagctggggacagtatgactttgaacaaagccagtccctctccctgccatcatggagctcacactccattatggagagacctgaatgggggcacaaagttatgggcaatccataactgctatcattttcctatgtgttcttacaacgagatgcaacacccccttttccccactcttcccatagataccgaaataacattaatttgtattaatcaaaaaaagctgtgtagccagggcatggtttgttgcactttaatttaaaaataaaggcttgacaacgttatgtatgatatctgagggtacatctgcaccgcagtaattaacattgcagcagtgccattttatctcgaatgctaattactgtgttttcaatgaactatttgggtgcgcagcatgttggaaaaagttatattatacagaccaggaaacaaaacagaatggagaagttgaagctgcaggggatatccaggttgcctctggctgcctcacagttctttttgttttaccttaattcactgcaaaataaggtgtgagatgggtgtgatgtccattttaccagcaaaggaagtaagcgggggctggtgaaggttcagtaacttatccagaatcacacagtggcaggtggcaaacccaggtcttctgattccaagactaatgatctcgatgtaagcaaatgcaagtgtccttgctcatttcagattaaaaaaaaatactttggggggccaggtactttggctcatgcctgtaatcctaacattttgggaggtcgaggcaggcggatcacctgaggtcaggggcttgagaccagcctggccaacatggcgaaaccccgtctctactaaaaatacaattagcggggtgtggtagcaggcacctgcagctactcggaaggctgaggcaggagaatcacttgaacccaggaggcagaggttgcagtggctgagatcgcgccactgcactgcagcctgggtgacagagtgagactgcatctcaaaaataaataaataaataaataaaataaaaaacaagtaaataaaaaatatgttggggattttcatttcttctccagtctctatttgcagatcttaggcagttccagaaaaagtgggatctttttcaggaaaagagaggactataattggatgctagcctgctgaagttcatcccaggaggaggcttcgagaaacctgaaggtcaaggaagtccctcaatttcctcacctgcggaattcatactggtttgagactggttggagctacgtatattgagggaagcaggtaataggtgctccacagatgtgcctgtccaggttgtatgtcaatcaatattatcttgataacttgagaccatctagaagcactatgttcttttgcaaagcaaaaattgtatgcctggtgtatttattttgcaaaattagatgtctttgcatagcaaacacagtgctttgcagcagtcagtgatttggggcctctaataaatggggtcatcttttttcattctggtgacactatcatgtttagagggaaataaatttggtcaatgcatttttaaggtaggaaaaattttcattctttgaaattcagccacaatcctgttcataaagatggcatcttggttagaactttactgggtgccacagggggtggcggtaaattctgaacctgaattttctctgttaatcatcacaatttctccctcaccaaacccagcaccatttgcttattctcagtgggaagatattaggctaaacccatatgtggagggaaggcctcccacagggcatacctgtcttacctggtttctatggcactttccatagaagcaaactgccatcagtcgggggccagaacttgacctcagctatctttggctctaaagcctgtgcttttaaccactggaaattattaggttgtgcagtttttgtttctgttttttgatacggagtctcactctgtcgcccaggctggagtgcagtggcgtgatcttggctcactgcaacctccacctcccgggttcaagtgattctccctccacagcctcccaagtagctgggattacaggtacctgccatcacgcccagctaatttttatatttttagtagagacggggtttcaccatgttggccaggctggtctcgaactcctgacctcaggtgatccacctgcctcggcctcccaaagtgctgggattacaggcatgagtcaccactcccagccacagctggttatttaacaatgtaatattacagcattttcttcaagaggtgggttgagagtgtaggagcctcacagtagtttggagctcaggatgtttaggattacttactgtttactcagggttctctagagaaacagaatagtgtgtgtgtgtgtgtgtgtgtgtgtgtgtgtgtgtacatatatatgtataaagacgggtaaaataaagagacaacacatgcgcacacacacatacatactactgtgtgtgtgtgatatatatatatatatatatatatatatatatatatatatatatatatcacgtaaaataaagagattttaagaaattgtctcatctaattatggacattggcaagtccaaaagcctgcaggctggaggcaagagctgatgctgtagtttacctctgaaggtaccctgcagaattccttttcattcagggaggtcagtctttttgatctcttgaggccttccactgattggatgaggcccatcaaccttatgcagggcaatctgctttactcaaattccactgatttaaatgtttatctcatccatagacattctcacagaaatatcccaattaatgtttgaccaaatatttgagtgccatggcccagccaagttaacacatcaattaaccactacacttattttcaaattctatttgccttctttattacatcagttcaaatagctcttaaccaaatagttgttctgataccacacataaagggttatatatataatacaaatatgcgtgtgtgtatatatacatgcatatattatatagctacattatctatatctgtatatattatatatacacatatgtatattatatatgatacaaacacatatgcattttatctatatatttcctacatcacataattttaaaagtcagctacacaaagactgttttccaaatgtcagtcacatagaaggagaaccagtttgaaaagatgtacatctgaatgatagaacaattataaagaaataatttaacttttcttgttaaagaacaaggcaggtttatccttgagtatagatgggaccatggagattattttgatgtaaatcccctattgttttgggtcttagatgttgtataaactcatattttgagataacaaagaggaagaggtatatctttttataaagaccaattcacaaaatacacatgtcaaaggtcttttggtttaatggagatagcgcttgtagggtggatgtttactgcagaaagctaagctagaggaaatcttaccttcagaaattccaaaagattcaataagtagctacttgcttgatgtgacacaaagattatgtgaggtttccgatatgttctctctcaaggcagtctgactcagatctcctctaatatagtaaaaaataattctctacagcttaaatggaaatataacactaaaaatggagtagctgagaggaaatagaatttcagtcatgcagaaggaagagatggcctatctgacgtgtacaggagctacttgcattcttaacccagttagttaggaaaggaagggtggaggacacctactaattggaggatttactatgtgtcagatgttgtaccactttttagattagaaaaccaggtacaggtcggctaagaattctactcaaagatacaaaaggaataagtgaggggactagaattcaagtcttcatgacccaagctcatgctcttcccagggtctcaaggagtagcttcaaagtcactgtagagagggtgcactcccatttctcagtgaccatgtacatttcagaaatttcataatgtcctttttatttatttactattctatatggaattggcacctgggccctgttcactggtaacatagaagagccggcattcttgcctttgagatttgggatacagtcttcttcagcagattttttttttttttaaccaacaagaatgagcttgaatcaacagattttcttttactataactataaaaatacataactataaacacgctgggagctgatagaccacaacatccacaacagcggcttgactgtggtgtactctgggctgtgtactcagtccctttccatcatcatctcatttcacccttatgctgcccaggtgaggaaggcattatccatattctgcatatgaggagacagaagctcaaaggggttaaaggatttttacttaaagcaccacagttagaaattggcagtcccagaattctagcccaggcctatttgactgcacattctatagctctttaaaagagaagaagtcagaagttggtaggaagagtgctgagtgctggggaaatgaggtagttgtttttttttttttttttgagtctttgctctgtcgcccaggatggagtgcagtggcgccatctcggctcactgctgcaagctccgcctcccgggttcacgccattctcctgcttcagcctccggagtagctgggactacaggcgcccgccaccatgcctggctaactttttttttttgtattttttagtagagacggggtttcaccgtgttagccaggatggtcttgatttcctgacctcatgatccgcccgtcttggcctcccaaagtgttgggattacaggtgtgagccactgtgcccagccatgagatgaggtagtttttaaaaagcttctggggttagggatcaattcttaattaaaatatgatgtctgcatggatatgccaggttgggtttaatgtatccagacctggtctagacccagggtggcagggcagttccagtccccgcttgctgggagttgagagatgggtcatacctgcctctcctagtgttggctgagcaactgggtggctgagcccaaaatgttgggaggccactcagtgaagaagattcaacggccgtgtcatgaattaggtgacctttctttgcaaccgaagtttcctgttatatgtctctggccactctgctgaggtgtgtaataggctttctttgcaatgtaattagtgagtctgagatttaagaacaccacttagtctagttttctgcaaagtagctcaagagatcaaagggctgatttgtaaagagtgaatacaaaaagccagtgtgctgcctgctcacatgggcactctggaagcatcgacgcaagaaaaaaaaattagtaccaaaaactggagtcaaatcattggcttcagtgcagcatagcagacacacagattagcaaacttaggggcgtatggattctaaagctaaaggacttcagagatcatcaagctcttattcaataaaccaggaaactgagacacagagtggttgagtgagttgtccaggattatgcaaacaagtagcaaacccaagattagaaatcaacccactgagtgtttcttgctttatgtagcactcttccccctcctcttattctcttgcttttcctttaaattatcttatgctgagggtacctaagaatactgactcaaagttagaaatgctagagtactataataagtgtgtgtatacacaactaccatagcctatagaaaaacagaaacaattcaagttgacatctggacctgccatttacatgacatgtatctagatactgggctcttctcactgtttgtccagatgttttatgctatgtagctttcatagtattgattagaaatggaaaagattagaggctagataagagcatggtggcagagggtgtggagctttaggagtaggccttttttttttcttttgcaatgcatctttgaaagaaagcagaagggaaatatttggagctcgtaggctggggctgttaggaaaagagtggcttagatgtaggtaaataagaaaatggaaccagactggagcgatctgcttcgagttaccattggtgggattgggtaggagagttgatgtacttctgagatctcacccactactcttaaccctgcagggaaaatagtgggtttttttcccttagtaatgctaagtttacgctgatctttctcttacctatccatctgagtcagcctgtgtttcctctgtaaaaaggataggattttggcatctacactgaaaaactagatgaaatgatcacatgcactgcttattatattaaatcatattattattaaaagcattgaatctgtttttgataatattgactcttcaaataatacatgatttatttgcacactctgcagggatgctaggtagcaccattgcagtgaagcatctcttcaacttgattgatcttggtaatgacaaaagacacagagaacaggtgtgaaagatattgcttggttcactaaggcgtgggctaaatcaagagaatgctccctttcctccatccaacccaaggataccatgggctcatggctggcattaggctgaacatgttcttgccacacgtagtcattggcgctgaagcccttcacctatttcaggctgcccagcctctgaccaggaaggcacacttcagagagtggtatctggaatgagtttttccctcacaatcctggtatgtaggtttccggggggtgagtcccatgtatttctttcctactgaaccaccactgccaaccaatggttttattagtttaatattgttattttaataatttagtattataaacaaaatttaaatttgttaatttgtcttctgtgtctgcttagctgccttatgaacattaaaaatcctgacacaaaaccttcgaggtcagcatgagcttcccattttccagtaagagggtggtgccacatgctcagctcatatggccagtgggttcaagagccagactgtgaatgcaagactgtccgatttcaaagtcaatctccttatgcttcactgtgcttctcttaagtgtcaacaagcaggcctaatccgtatgaccccagttcagtgtgggtttctggtttagttctccaattcctttacctgggttaaaattcggctttaaaccttagcccactagcatgtggagagcctggagagttcttgtcaagcccctcattgttggttgtctggatcaatttttttttcttacttcttagtgagtggctggagtcttatgccaactggataaagttattggaaccaagatggtaccagctgattgattagcagtatgcccccaatggaattgcctgtgctgctgctcctttcatgagttgggggctcaccttggctatctatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttggtttccatttgttggatgaaaatggataaggttttgctttgagcatcatctgggtacctggtccaagctccaccccccattctgcctcagtaggtctgaggtgggactcaggaatctgatgtcttcctctcctgagcttcctttgatgttcatttgagctgagtctgacagttcttcagtgcagtggggaaggggtacagtaatatagagtgactttttttttatcctttctccatcctcccttcgtgccttaaggaattgctttgataattataaagatatagcactaaagctctttctaaatatatgtagtgggttatacattgattcatcttcaggccactgtttttccctaaactacgaaaattcaaggttaggctgctttaattaacatactaaaacttgccttagaaagcttatttctagtttaatgtcatttaattcaatccctgattcacagggcttcaggcaaataactcccgatctccagttattttatctccaaagaggaaaatgccttttaaggggtgcctgtggaacacagtggcacacaggacactggcagggtccatagatccttcttaacattccccgtgtggtcatcactggtcagatgtcagaatccttgatgccagtttttcaaagtagaaatagcaaatgtttgggggataattagatagtaagtctttgctcattcgtcatttcattgtatgcaagttaagtatgtaacatttatttcccatggtgtccttgcccctataggctctctctcactatgactgctgtgctctaggacacactgaagacagccacagtggtcagcagacagggtaaatcagtgagacaggccaggtgtgtgacagcagggagcggtggagatggtggcggtatggaggagcatcatctctcatctcttggatgtctttggggcagtattcaggacactgggagatggcctctggaggaggaacagagagaaatgcaggaaaaggaggggatgggatgcgagacttacttttcattttgtgctctttcatattgtttgaattttaaaaataaacagaatcatttttaaaatgaaatgaaagactctgtagacaatcacatctgatggtataacctgggatgtgtgctacaagagtcctgtccaatacagcagctatccaaaagaaacagaaggcaagctacatctgtaatttttaaattttctagtagccacattaatgaaacaaaacagtgagattaacattaggagtttatttcatgtaacccaatatatccaaaatattatttcaacatgtaatcgatataataattatgaatgaggtgttttatattcatttttcataaatcttggaaatttaatatgtattttatactcaaaacacattacaattcgaactcaccacatttcaatcgcggcatgtggctagtggctgccatactggaagtgcagcctggtcgggtcagtcttccttcccaagctgccctcccttatgcgaacacagctatattaaggagtggccggctgggcagctgctgaggataccaggctctgaggaggcttaaacactccatgaataaattaggcatctaatgccagtaacttatatttgtttcctacccccaaaacagacagatagccctctatctgttgaggtttttttctttttgagtgtgtgattcatattgcaagttttatgggccaaccaccctgggagcagccaagtgacagttgcctgggttggcagttagaatctattgatgttgaaactcagtagtgcatagcttagtgctatttactaggaatacataatgtgtcccattatctaaattataaacctcttaatatctctcctaagaatttggttgaatctgaaaatcatttaaaaaaactgaaaagataaatgacataaaagtgggaaaccttttgttcacaggtatatttgttgggagatgatggaagaattcccaggggctttcatttcactgcttcttcctcctcccaagattacctaatccttgctcccatcttgaaggtcaatcatttattctattcatcaaagctcctagttttgtcagttaatgactatgcatttggtatttcacattgctgtccagttttcaagtatttgcatttctcagtggctctgcaagtgtaatgaacatttgctgtgccgtggaagcaaggcgtagggtcctaaactgatatatagacatcatccacaaccaaaatccaaacaggtctctacccttcaggcacttattattggatttaccactgatgctatttacaactgaagcccttaacaagtgaggtgtgaccatagaaaaagacaccagtttctagaaactgcatgcatcctttctagaagcaagcaaccaaggagactgcattttctaactagagatcatatctagatatactaataataataatccatcaatatcactaccatctacagagctctatatggctgcaactatgcatgcattagcaacttgatccttgccactacctcatgaagtggatatttttattatcaccatttgatgaagaaactgaggctcagtgagggtaaataggccacagatctgtaagtgtaatagataatacatgtgaaagagcccatgcctggtgagctgctgtattggctgtaaggaggagagatgatttttgtccatgggtactggggcatttcctggaggagtaggcatttgaaatgggtgttggagcatgggttattggctctaaggaggagagatgatttgtgtccaggggtacaacaggcatttcccagaggagtgggcatttgaaatgtgtctttgagcacgggtaggatgtaggcatctggagatgcctagaatagggaataaaatcagtgaagacttgggaatgggcaaatataaggcacacaaagggagtggcaattgtcatgagtccagtgttcccagagtgattggaacaggagcagctgcggggaggggtttgcacagaagatcggtgacagtaggtgccaaacacccactgtgtgacagattctttgctagggcttcacatagttctattatttactttccaccaaaatctgtatggtaggaagtattactatctctgagtcacaaataaggaacaccagactctgaggggttaaataacttgctcaggtcatacactagcaagaaaaggagggagaatttgaatgcacatctgtccaaccctttccactgcaaaatgaaacaaatcatgttttaaaaagacacttttccgaggaaataatgtcctgcttttatgctctgccctgtgacaccaattctccagagttgctacatttctatatcgaggcaagcccccactcttggtgcctcctctgtgatgtgcatccccacctccactcccaccgcacctctttcaatggtcttctccctcttgcctggtctttgcctaataggaataaaacataaaaatcaaaacccaagaaaagcccaatgtcatgattatcaagtagctcacagcaccagctaggattttaccttaggggtgagaagatttatattgcaataatcaatatctcagaaatatgtggctcactttctgcaactgacattccatttcatggcttcaaagcaatggttacatcagccagtttgcgtctttaatatagtgaaatgcctactgagggaagtcggtggagcatgtgctgtgggggtggggagtctttattgccatctaatgaccctaaaatcagctctctggttatccagcacgggaaagcaaatggaaccttccatctcatccatgacaaaagtattgagtggttctgaagttatttgtacaattgatccagctaatatcaggaaagcatgttcaccagatgaattagagacaattaaatgcaattctgtgctcctgttttctatacacagaagacaatcataaacccagagggtccaaatgaaatcatctgacccattttaacaccctttccgtcccacattcaccattctagtccactgaaaagcctctcagatttccactcgatgaggtgatttcatggtgcatttctgctatgcaatccccctacctcttttactgtcaatgaacttaaatgctcacagcaaaacttattttcatgagttcctttcagttgcttatatacacacacacacttagcagagtaacctttccttcttctccttcttcacctctgacatacactcattcaacaatttaaagaaattccacctcctaaaaaccctctgtaatctgcccattctctctgtctctgctaatgtatcttattctatccctcatcttattctgacccctcctctctgtcccccagacatggcccaacttaagcccttattttaccatatttcctgaaatatgccataggttgtgaaatatatcctgattttatgaaccaccatgaaagtaaaaaaaaaaaaactctacaaataaaataaaataaaataaaatatgccattgtttgtaggaggcctcctaaagagatgttgaaacatgaaaaaaatgtgcatcttaaatggatgatacacagtatctctatgaaactcttatcattgtctcctgactgctcatgccaacaatcttgtagtggcacaacaggcccttcacaatcaggctctgagctgcatctccttttcctaggcttgcaaagccccttctcatttgtcaagaccacctcctcaaagtcctttgaaaccccacaggcttggtgatgatgcttccctgagttcctatgacttccttaacttaagcgtaataacacataaacatagctttgtaattatctgcccccatgtcccactatgagaaatccttggagaaaaggctatgtgtctccttcacctccatatccccagtccctgacacaggacagggcaggtcctccttgaattgctgaatgcaatggactgtgtgatacatgtagcttctgaacctagtcactagagggcagtgtggaaccatcccattgcccacaactgcggttccccaagaatctaggttgcagaggttgtaggaagctggcctatggctgagagcctaggaggctacatgactccaagggcccagtaccattctgcagaatcgaccctgaggatgctcctagcatctccgtatttcttgccagcctgcccactaggtgctttcaagtggctgcctcagcacatttcttgattaagaaccaaatgctcttcctagctctccacctatagggatgggggcagaggccacagagagggaaataaacgtctccttaacatccccattctcatttctaataaaggcaggcttactgtgaagggcctgcaatataactgctccactttgaagaacaacaggtagcagcatcaatatttgatttttaaaaggttgtgtgaacagttttaaatattaaagataaaggcaaagacttagatcatctttttatctcagcagttgaagattttaaatgaaaaatggtgctaatgagcagaataagactgttcacccatcaaatggtatctggttgcaataaagcaaaatcattttggggttggggggagaaggggtgggaagcaatatctgtaccagagaagttttctgttcattatctctgtaatgagagaaaaataaagccactctgctggagtaactttcttctatctcatcgtgggctgtttagctccctcaatgagtggtctgggacaggctccgagaaacctcataaattaactatccaacttcctggctaatgagcccaatatgtcaatttctagtgatcaaaatgatgcaattcaatacagcacagttcattttgtaaggaaatatactcttaatagagagaactgcagggtcaccgtcttcccaagataattatgggccagagaattagaggcgtggagctgtacttactgtctggagatatcccatggggtttgtgtggcagatattgtctttcagggacaataaattccttcattatatttccattactgcattaatgcagcgatctccattttagttgtaaccaagaaggctggttattcctgaaacttggcatttaatgctaatgagagcttgcaaggcaggcagctccctgtgtgtgtgtgtgtgtgtgtgtgtgtgtgtgtatgtgtgtgtgcatgcatgtgtttagggggggttgggtatagacaatccagcagaaatgtcaagaactagaaggtaccagggagagtctggagggctgagatggctctgaccagacagacagatggatatctggaagagtcaggggtaagtagtctgagagccaagagtaaattacagctgaagagagaagctgagatcactacgaggtaagcagtgccaagtgtgaaatccagcctgagaaagcaggtggtcctgaaggtgaaacaaacagatgcaattcaaaaacaggaatgccgggcagcaaaagggttcaggaatgctcggaagtaagcaatggtgctgtaaactcatcctaattcagggttgcctacgaggtatgagaaaaaaccaggcacttggtggtggagccaaaggcagccctagccaatgatatctctttaaaaggctccagctcaaggtagaccctctaagagcaaggactccatgttcaggcttgctggaattgcttgattctataatctgcaccccaaaataaggtacttatttggttttaaagttagaagtggatgaaaatgaattccacaagtctccatgtgagagctgatgaagctccagcatgctatctaaccatgctggaaggctctgatctggcagggagaaccaggtgggaaatactggtttcactagcatttttcaacttgattccagtggagtggacaggcaacatagtaggagaaaggacagctcctggggtcaggttcaagttctggctcctttgctcttagcttcatggtgttgggcaggttgcttaacttctctgagctgtggtttccttagctgacatttaatttgctgggcaatctatctatttgcagggaagtggggagataaatgaatatgtcagtttgcttatttttgcttatttttatttctccaacaccaaagataagaaaaaataagttataaacagaatcaggattctttcccttgaagcaattcttatctaaaatggactttagtcaggaaagtaaggttgctgttaactcaagtaacttgggaaaataattgtgaaaagaaaaattttccatgaatcagagagctcaaaattataatatgttaattaggaagtgtttacttaaggtgagaagtggattgtgctaagttcaacatcctgccagaggtcctcgataggcaatgactggcaatgcccgttagcttgctccatccttgcaataaaactcattgtccagaagtcttgggaggtgccttggtagagatcagttgctatttaaaaaatctctaactgttgacttttaccttgtcttggccattgactaaatccaactattgtgcactgagtgtttactaactgcaagttcattttaaatgttctctcatttgatctttataataattgcatgaggaggatttaattatgcctgtatttagagatgagaaaactgaggctcagggagtttagcttaatcacatggttagctactaatagaagaagaggggagtttcacactcatacttcattcatcattaggtggatttcatatctcacattatttttagtactcatcctcagtgactctggctttgagcctcttaaatttgtaaaacaaacttgatattttggaataatttcagtaggtctgcagaaaagttgcaaagatagtacacagatttccatatatccctcacccagcttcccctaatgttgacatcttatgtaatcattgtacatttgttacaactaataaggtaatattgtttcaccactatcaactaaaccagtgatcccccacctttttggcatcagggactggttttgtggaagactatttttctagggatctaggggtggggggacagctttgggatgatcgaagcacattacatttattgtgcactttatttctattattattacattgtaacatataatgaaacaattacacaactcatcataatgtaaaagcagtgggagccccgagctttttttttttgcaactagatggtcccatctgggggtgatgggagacagtgacagatcatcagtcattagattctcataaggtggacacaactcaaatctctcacatgcttagttaataatagggttcatgctcttaagagaatctaatgctgccactgatctgacaggaggtagagctcaggcagtaatgtgagcattggggagtggtccatggcctgggggttggggagcgctgaactaaactacagactttatttggatcttaccagttttttcacttatgtctggtttctattccagaatccaagccgggatactacattgcatttagtgactctcagttttaacctgattatttgccacaatttccttcgggaaaagttcggggtagggataaaggctaacattttttgtagcctggatccacataaagatgtgctttttttttttttttcttgtttatcttttattttgcttctggtagcagcagttcttaaaactcatggcacacgacactttcattttggcctgggatcttggcctgcttgtacaatagctgcaaaggtttgggattgagattcagctttcaaaagcgactctccatcactgtcttctttcaaggacaggaaatttcaaatcaactttgggctttaccattcagtgtgccaaacattcctgaagtttctacgattgccaataaataagacattccatcatctttaagacatcaaatcttctgataaattgaatttcataaaatattgctctattgatcttagtgctcaactttcaataaggcaagccagcaagagttgctggctggtactttttctgcaatgaggatgtcatctgcttacatggggagagacatttatgaggccagggttcctgactttaaatttcagttcctggcactatatcaagtccacagtgatgacagttaccttctctccattgctgctgctttaactttatagaaaactttgcttatgcttattaaacaatgtggcacaaaccctgtgaggctacactgcaagtcatgtaagctagtacttggcacatagtgggtatgtgatctctgttaaagctctctttccagctaggacaaaggaaaatcaaacttgtctcaaaactcaattttgagagttcatctcgttttcagaaaggaaagggccaatgatgaaaactgatgacatggcaagactgagaagaaaaaaacacagtatttcttctccacacggtttttccagggctgctcttgaaattgtctgcaatgatgtgcatgtattttttttaattttaaaaacaaataacatttttatacttttataatgacaacatgtcttgaatgccatctgttcttgccatttgttaaggcaactcaatgagaaaacagcattcggatgactaatatttagcctgctcatagtttttaaaatggatggacagattcccttgagattacaccccaggatccatggcaagctggtggggtgggagagctgaaggtggagtttttgccactactgggcacactgggtcactcacccagcatttcttaagcaatcacaaggtgccaggcagtgtgctagaactagaaatataatacaaagataaaagagagactcatctctcttgtggggactgaggagtaaatacacaattctgtacaaaatggtaagtgctaagacagaggtttgcaaagggacgtagtgaaatatgtagaggaagttaatgactcacaccgtgtgtgtgtatttgggggtgatggggagtgggttaaagggtactcagaaacatttctgggaaggaaataaaaccctgacatcagtctagcagaattggtagacatcagctatatgtaaaagggggtggattcaggctcacataaatcctatgagaccagcacagtgcatcaaagatatatttccagtcatccttctgtttgaactagaccagagaaaaagtgtattcaatatagctagtgagttaaacactacttcctgggcactcaccagtgcatcctaaaacggttgatcaacatgaattgattgttcagccccagaccaggtaaagaggggatataagagaagccaacgtggttgatgatgggagggcagccgcaattcagccacaggcaatgatcaaatagcaatgtggggcagtgtgtaaatatgggggtccatttatgctcaagaaatgggtgcatcctctgttactctgaggccataaagttgctactctgagtcttttttaggccagttgctggaggatctggtgtagaaaggctagacaggaaggagatctaggaggcttcctcccaaatctaagattctatatctctgttgctcttttataggactgaggttaaaccttttaaaaatagcctctgtagttttttttttttccctagagctatttgggtgtgcctgtctgtttttaattcataagaatgcacagtagctgcacattgtaaaatgcattcctgacaccctccccgccccgcccagaaataaaaagctttccaggcatgacttctacgttattctctaaatcatagttatctgtggtgaccagcaagttaccaaatatggctataatatcctatgttttctccatatgctatggagaaacaaagaacccctaaacaatgaaaactaaggagacacaaaccctcccccgagaccctaggcttggaggggcacgaaataataccaccattaatactaatatttgctaaactgtattgtgcaaatttgctcaactgtttcctctgtttcctatgtgcaagaccctgtgctgagcacagtatctcactgagtcatcacagtaatcctgtgagctggtactgattgtattaggctgttcttgcattgctatacacaaatacctgaggctgggtaatttataaagaaaagaggtttagttggctcatggttctgcagcttgcagaggaagtgtagcactgtcatcagcttggattctggggaggcctcagggggcctttattcatggtggagggcaaagagggagcaggcatctcacatggccaagtgggagcaagagagagatagtggtgggggaggtgccacacacttttacaaagaccagatctcagccgggcgcagtggctcacgcctgtattcacagcactttgggaggctgaggcaggcagatcacgaggtcaagagatcgagaccatcctggccaacatggtgaaaccccatctctactaaaaatacaaaaattagcctggcgtggtggtgcatgtctgtagtcccagctactcaggaggctgaggcaggagaatcgcttgaacccaggaagcggaggttgcagtgagctgagatcgtaccactgctctccagtctggcgacagagtaagactccgtctcaaaaaaaaaaaaaaaaaaaaaaaaaagaccagatctcctgtgaacccagagtgagagctcactcttcaccaagccattcatgagggatccacccctatgatccaaacacctcccactaggctccatctccaatactggagattatatttcaacgtgagatttggactgggacaaatatccaaactatatcactaatgttacacttgttttatagatgtgaaaaggtgctccttataatggaggatgattgacctgtccaaaatcacagagcaagatggtgataaaatcaggtcaccaagccaggcttgcccagtgctaagacttctccctattatatcacctcccagaattaagacaatggagttttcccatgccacacccagcattgcctactctctgtaatggctatgttgggtctggagactccgattttccatgaaactcagtagtcatacacttggaaatctcaagttctgcctttcccccttttggcatgggtggctgtcccactatgtctcagccttgccacttcttcctaaatctgagaaagtgaatgttagccagccctgactctttcctgttgacttagcaagcactgattgaacttgtacttggaacaatggtttcctaggttctgagtggcagaatggggcaggaggggaggagaccagtgaggcgaggcttgaccaataccaagctggctaacatcaatatggctctttaccattttacagagagtgttcacacactcattctcctatggttcccacacaggaatctctgaagtaggagcaggcatcccatctcacaggtgaggacaaagcctctcacagagtgtatgtgcctcatctgtggccacgtgctctgcagaatcagggttcaattaccatccctgtgatgcctcgtggagtgctctgcattgctgctggaatcctatgtctcctcctacttactttcctctatttcattctcatacatagctgaacctctctgtgcctcactttcctcatctgtatatggggagaacaatagtggctactgttttgttgtgaagattaaataaggtaatacatgtaaagatagttgaaagagtacataacacataataattacttaacaaacattaggtactcatagttactattaacaattactagtattaccattactgctgatactatgatgcacacacaagtaacaattataaagatatatgcaaataaatgcaaatgagtatatgcacttgcttattattttacaatgaaagtgctgaatgatacgaagcaaaaaaaagtgatataaaataagatttcctaaacttggctgtttttgatatatatatatccctaacatttcatgtttcagtaattaaggccatgaagagaactaaaatattgactaaatcctggaggaatttccaaatgggaatgatggaaagacagacacagagacaggccagccaccacagccaccaggttaaaatgagggaaggcctacaattgccatgggaacagagaagacaaggagagggaaaagagagaagcatttttttttttttgaactaggccagctaacacagttatgtaacttaattgtcataactgtcatgtgagatacatggtattagcctcattttacaaatgtggaaattgagactcaagttcaagtaccttgttgaagtcacaaaatgaaatggaattttaacagacttttactctaaaacccatgctttctctacctctctaccaccaacagaagcttctggggagcacctcgggagacagccttttgatgtctcccttctctgggctcttagagcacttagcatctctgtaattcatgcacacaacactcacacacagcatgcattgctttatgtgcacaccagcaagtgatccctaccaccaggccataagctccttcaagacagagtcagcatcttagttgcttttctatttcctacctgactaacatattgacttgtacatggtaagtatctgttgagtaacctagtagagaagagagattctatgatataaaagactgaggagaatgcaaaagctttcataatcaaaggttgctcagtgtgtagaacattctggaagccaggttggagtgatacattcccaaccctggttatagaggactgactcaagtatggatcctttactgcagctgagctgctcagataattgtctttcttatttgggactaggactagggagattacatctggggtagtctcttagagacaggggatgtaaactgaggctttgtgggctagtcatctcctgtctgagaagcagagagaaggatgaagtagacattcagtaggaagacaccctcagagcctggtggagaagttgctagatttctgcaggattatcatcatggaaaggatctcactgggcctttgaagccagattgctcaggtctaaatcttggttctgctccttataatcagtgtgaccacgggaaaactgtttaaccagcccatgcctcagtttacccctctgtgaaataaagatgagaataccttcctcagggtgccatgtcatgtgcttcagcacagtgctggatgcataatacaacttcgatgaactgtagctatcattttaatgttgggcctccatttgattcttttgtgctttccatctgaatgtttcaggcatcttgtatactttttccttcctgctttcagaactctcagaagtccaattgctacttgcaacacaaagcaaatcaagttggctcggttgctggtagacagacctgtctcttcggtggtttctgcctgagcatatttatcagctactagccagaaacacacacctgtattattataagtggcaccccaggtcccagcacatttcaaagcacagactcttctctccttctaaggagaagggcctctgcttctttgttctctttgattctcagggcttcttattaatttggtatagggctggggatattaatgtcctcttgttgtcaagaacattctccaaagtcatgaataatcacgttgtcatgcctgtgtgacttaaaatacaaaaggtgcaatttatgcaagttttaaagttactttttcaaaagagttcaacccatgaagctgtcaggctgtcagaatgtaagcaccaaactagaaccttagcacttacttatgaattttcaaaggactttagcacatttttaattagcttctccccctgcccgcaagcctgcaaaacaatctgtttggctattatattctgtgagtggggtagcaatataatgctagattggtgggaggggtgagtggaaaccttgcttcatttaaggtcttttttttttttgaggtggagtctcgctctgttgcccaaggtggagtgcagcggtgcgatctcagctcactgcaacctccacttcccaggttcaagcaattctcctgcctcagcctccctagtagctgggactacaggcgcacaccaccacatccggctaatttttttttgtatttttagtagagacggggtttcaccgtgttgcctaggctggtctcgaactcctgagatcagggaatccacctgccttggcctcctgaagtactgggattacaggcgtgagctactgtgcccagcccactcaaggtcatcttctaggcttcaaggccatgggccagaaaccagttttttcaagtaatttttatttttattaaaagatagttgaggaaagaaagcaggatgccagccagccagccaagatacatgcagaggtttttaatacatacatcctatagttacgcaccatttctccaagcacttataagtaccccaattcacctgaccctcccaacagtgccatttattcccctcctcttacagatgggtaagcaggttcccaggccttgggagaccattgttccccatacctcctgactcatgacaagggactgttcccagagaaacacttctggactctctgccccattctcactcctctaaagggggaggggcatacttctgagactggtgacttgagtgaaaggactgggcctgtgaagctcagtgccatgctatctgctctgaaaggcctgctcacagagagggcacagtctggtttactctcttggctgtgctgggacttcagtggtaaagacctgtcctcactgaggtcagcctgatggtttagggtaagtttaatttggggtgatggtgtggacaatgctctcaaattcactttgcagcatatgttagctggatcccctacacagttttcatcatccataaagctaacgttttggctttcacctgactcctgggtctttctcttaatttaagccatgcagggtacaaggggggtgggtagggaatgttatttactatagccatctccaacacaagtaagaatctattgtaaatagcaaagctgttcttttatttattccacacatatttattgtgtatctactatgtgtcagggcccaggttttaaataagagtcctcatcaagtatgtattttagtggtggagaaaggcatttaacaatgaaatgcacaattacatggcaataaggacaaagcaaagaagcgtgggatgctgggagaatgtctaacagggagcacgacatagtcttgtctggaagttgaaggttgttttctctgagcaagtaatatttaaacaggactcagggattagcaggaagaggccaagcagagtatgtatgtggggaagaatgagggatgatctcttcacgtggtacttgggaacctgaagggaggcaggtgtggctgaaacagagaaacagaaggggaatgggacatatggcaagatgcagctggtaaggtaggccaattgtgcaggatcttgtgggtcagattgagaataccctaggtgttttctaaggtctagagaagatcttagaaatgagaagccattgaaagccttaaagcaagagtgagatacactgagatttggctttcacaaaggtcaccctagctgttgtgtaaagaatggattagagctgaggcaggcagatcacctgaggtcaggagtttgataccagcctgaccaacgtggcaaaagcctgtctctactaaaaatacaaaaatttagctgggcatagtggtgcatgagcctgacctggtgtgagtagccccagctactcgggaggctgaggcaggagaatcgcttgaacctgggagatggagattgtagtgggttgagaatgcgccactgcaccccagcctcagcaacgaggtgagactctaagaaaagataaataaatataaaaaataaaattttatagtagccacattaacaaaagaataaaacaggtaaaatcagttttaagaatatagaccatttagctcaatctatcccaaagatgatcatttcaacaggtagtcaaaataaaaattattaatattttacatgcatttttaatacaaagtctccaaaatccagcacatctcaacttgagtaccagattttcttattagtacttgatctgtgtttaaatttcataaaacttgtagttgaaaaaaatattcatacacttaggtcatactaacaaatttgaaagctttccagtaactgaactgagtatctgtttttcaatttaaattagtccacattaagtaaagttaaaatgtcagttgtttgcactagccccatttcaagacctcagtagtcacatgtagctagtacctacacgtattggacaattcagtcctggagaatctcatctgtgtagcggggcgtgggagtcaggtttttcagacaccaagggccaagaaccgttcctggcactccaggcctgcctgcgattgggcagagcagactctcacagccagaggaagccagaggcagttggtagttaggtagccatagaaccctgatgaaaataaaacccaaagggaatagggaagggatgaatccactgcaagagaattcatgttggaaacagtttatagactgaacaaaatgagaggaaaaaagagagagaaatcaaatatgatttgtaggtttctggcttacaattgtgtgaatagtagtagcatttactgcgataggaaggatgggaggaggccttggtttggaaataaggccattggtttgattctggacatttgagtttagagttcctgtgaaagatccaagtggtgatattgagttggctttgagatgggccagctgagagatcaagaaatatttcaggacagtttagagcttgactaataaaaacaacgtatttcacttgtacacagattttctttaaccaaatgcagatcaaaaatacagtatttgagggatataaaacccacatatatggagggccgatttttttgtacaagagttctgctgagcccactacaggacttgagtatgagcagatttggatagacttagaagtcctggaaccaatcccctgtgtatactgagggacaactataaagggaatgatcagatatgtgtatagtcatcttaaatattatagcatagctcccaggctgggcacaagatgaaacaatggccaaattgcagatattaatatttataggccaggcgcaggggttcacgcctgtaatcccagcacttcgggtggactgcttgagcctaagagctcaagaccagcttgggcaacatggcaagatcttgtctttacaaaaagcaaaaatatttagccaggcgtggtggtatgtacctgtggtccctgctactctggaggctgaggtggaaggattgcttgagcctgggaggttgaggctgtagtgagccataattgtgccactgcactctagcctgggcaacagagcaagaccctgtctctcactgtccataaatattatatatagatacaaataatgtggttattgatggagcctcatctgttgtgaggcaggattggctcacagcactcccctcagtttagatagaaaagatccttcaggaatgtatgttcccctttgctctccgagtccaagtaccttttgttgacaaatgatagtaaagagagctgtcttgggtaaaggacatagtcttcagaaagtgcactctcattctaaataatagcagccttcagatttatgctgtcttcttctgggtgtttgtttaccttgggttagtctttttgggacccatcaactctgaaggtcctgtttcatgggacaaagccgctattgggcacatgaaaagctctccccagactcaactgatggactggagaagcaccagaggcacagctcacagcccttcagacccagcatgctgtggaagtcaagcttggtcagctggccttgcctgtaagcttgctcaggggcatagatcgctatatgagtactcttcagatagctttctaaggataaggccaccgaataggtgatccagatgatgaggtcttacaggatttaacactttgctagtaggttttgttccattaacttagatgggattgcagaaaacacaccttgaccacatggtaatagtcctgatggctgtaaaatcacatctaacacctttacgcagaggaaataattcagtgtcaatcatttgttcaactcaaactggtaaagtgcctacattttcccaggccttgtgcgaggcatgggactcagagatgagcagggcactttctgtttccgaaacaatcagaggagagtatgctagaaggtacaacaaatgcaggggatcccagaaatggggcctctagctcaggctgctcagggaggagaggggtgtttcctggagaaataaactgcttagcggaaactgctgaggaaatagaaacactggagcctcgtgttcttgggtcagagttggacccaggaactcaggcttctacctcctggaaggtgctgacctccatcagccagctgaattagcaccattttatctacagcaagatcaagagagagtctgtggcaggaagtacagagcctggggactgcgaagaaacagaaaactataataatactgaagccctcagaaccagagaaggggacttccagggtgcaacagaacaggtgtttgggagttggcaggttataggcactgttttccctttccaaaaatgggagaaaggtaagtgcctcgagagccctgtggaggggcctggtgtctcggggctccctgtttgttacccctgctctgccctacatcttcccagatggaattctggccacaagttatcaggttgcagatgaatagtgaatactttttttgaatttcatcattcttccccctagaatgactcattacaaattctgcgtccatgtgatgcattaatattgattaagaaacaggtgctctcagattcaattagcaaaactgcaatgattcacacagggttacgctggaaaattgggggaaaatatgcaggtgtgcaaatgagcctaatctgaaggtgctgcagcaggtcttgaaaaatgcatcccctccagcaaatgctttcctggaattaccctttgtttgggtgacaaatggacttgccatttcaaccaaacagtgaccccaaacctctgtggcttaggatccagtggaacttcacatttggagtcagacttctatgtcgggattcccaagctttcctgttgaaccactgcagctgtttgtgaaacacacagcttccttggccccaatctaggtgattcaaattcatggatttaggtgaggaacctgaaaatctgtaccttggaaagtaattcatgtgcctcttgtcatagacaagttagggaatgtgcctcaggagaaggctggaaacttggggctgggaagtgctgcctgcggttggatgatggtgggcacctcagcgacatcagccacccctttctggcttggctttgccatatgtagtatccagaggctatatctctccctgtggatgctgagtgagtagtgttctgatctaacacacataaaacaggaaggaacatcacgatttggcaattaatactttttaacagaaaaaaaactttaaatagattctagagtgtaatcatagacattcaacctggacttctagaacattcttgggcttctttctagcaaaacctcctttgacaacaaaagagagtttgtgacttagatgtcttcctgactgtattttagagtgctaaacttcagtcatagacatcagagtctcatagaatttttagggcagggagggacatttgagataatctagttcaatcctttcatggtgcagaggaaggcatgcaggctcatcaaggtggagagacttgctcagtgctacttgggaggtaagatgagagaactaaagatgagacagcacattttccgagtcttggcttccagctcccagtgcctctttctggccaccacactgtttctgagatcccctcattatttgaccacagtatgctaagaagcagggaaatcagcaaggacttcattttctttccatacatattaagtgagagcccaatatattcaaggaattgagtggcatgatgaggggtaaggatgcaaggtcacatggacacctaaatgaacaactgcaataaaatatgacaaatgcaagagtagaagtacacacggagcagtggcaactcaagagagaaagtgactaactcctcgaaaaattagggacgtcttctcagagggtattgagtcaaaagtcaaatcttattatgtcctggtgaaagaaatggcacacctggcagaaagaacagtgtgagcaagagcctggaggtttcgaattctaaagcaagtgtcagcaaacattttccgtgaagagcaaggaagcaaagatcttaggatttgtggtcatatggcttcaactctgttgtggtagcatgacaacatgtaagtaaatgggcatggcagtgggctaataaaactatttacaaaaggaggcagagagccatatttggccagtgggctgcagtttgttgacactctcttctaaatatgtgtctatcataagtagttcaggatggttggagcatagagcttggggaggaagaactgggagggaaggcgtgacaagatgaatctgatcagcttagtaaggacgagatcaagaagggactccaatggtaaagacatgcttggacaagtcatttatcatctctgagccttacctttctcatctgtaaaatgggaataaaaataattcctgagaaggactgttgtggatattattataatatctgagataaatccagcacagttcttgacatttactgagtgttgtaaaatgttggctgctattcatggcactttctccataattgggatgcatttgaagatggagatgtgggattgtcatgagttcggaaataggctctagaagcaaggtgttttgttttttccagcaggttaaataaggaaaagagatgctatttggccatgagtccagaggggaagtcttcaatggaggctctagatcaaatggcctcttattatctgaactcacttgcattaataatgatgaaaatctacttgttcatttcctccactggactttgagttccttgaaagtggaccaattcatttgtcatctacagaaccagaaacacaataggactcaatgaatggctaataaagatgtctttgtatctgtttctctgtctgcatgtgacacctcccttttcttttcccctttaagtcccacctttatccctatgccatatagactttgctgttagaacaatcatgacatgtaacagtttttgaattcttactatgtgctaggcataatccttaacaatatatgtataccattttatgtcttatataatgaggtaggtattagataacattgagataggtattgttattattcctattttgtagatgaggaaacagggctcagaagatttgctccaaatcttaacagccagtaagtggcaggactgggatttgacttatctgactctcaagcctgagtttgtgcactgtcttccgatgttctaattcattccatgtacattagtctctttccccaatcagactgtttgctgaatattttatttctttcagtacccaacctaatgtggaaaagcagacatttattaaatactcagagacttaatttgaaaagacttttgccccgtggtcatctgaatactccaaagaatgtactactaacttgttctcacctttgggaatcaccaatcttttgtcatatgggaaaaatgaaaatatttttatctgtttatatgctaagcagcattataacagctgcctgaaaatctaggcttcccatccatcacacaagcacctggatgctgtaatcacagatgacaaaccagctcatcagtgaggtctctttgcagaacaggtttgatactagggatcttcatggagaaaacattttctccatcaaaatgaaatgaaggcccactggactagaatcttccttttaacaatggcagatggtatccagcattggttcatttctttctgataagaaaaggccaagcttgcttctttcatctcttcattctccatggagccaggaaaacagaaagaaaagtatgatagatgtgtgtccattttctgattgtccagcgtccaacccccttgaccaagagggatgctgtctctcctccagtgtgtatgatcttggcaggaaagcaattctcaatgcctgtcctccactctggaaacttggagcttagatccttccaatattcctggttcagcagggaggcaggatgttgcatcctgagtatgtgatagcaaatggtggcttggcagacatcagcttgacccagcagtggtagagcagtgatggtagcagtgacgtatcagtgtcactgacagcctcctgaccagcatgtggttgtctctgatgcttgacttcccttgctccaagtctgctcttctaatttcccaccaatctccttccagaaaaatctccattttgcataagacagccagagttgatttctgttgcttgcaaccatgaatgctgagtgacataatatgggaagtagactttttatctacaatcacccagctgactgttgtctaaatagtcatctcttttccctggagttgttttactggctgaagagaaatgatttttttttctttccttcccatatttcagggacaatgataagcagggtaatgcccccaaagcaggaactacattgaaaatgaatacttattgaatggcccattagagaagtatgaaagctcatgttgcttttactcattgctctattctcaaaatgtagaacagtgtttcacacaccctgggtactctgattaatgaattaattacatggtacttattaatggctaaataaaaactcagattttcacatttagtcttcacaacaaatatacaaactagcaaccactgtctacattatacacataaagaaaccaaaccccagcaaggtcaagtcgctttcccattattgctgattaatgttggagttggaattctcagtaaggaccacctaactccaatccaggctttttctattccctatactgaggcaggcaaggagaataagaaagaagaaggaaaaaaagaactgaaaagaaagaaatagagaaaagaaaaggagacaagaaaagaaaaggcagtgaggtgaggtgaaggtctggttggtttaaaggggggtccttttccttggataaatgagaatttccagagtcagttctttctcagatacaaatggcagaagagggtgggctctgttaggtgctgaggttctgcagtgggaccaggaggctgaggttctgaggttcatcctggcccagagagagcaggtgtgagggggccgctgagcagacagcacagcagttcccatacacagctgtgtaggagcaaggctggagagctggcctgctctccatctttagaatctgcctactgggctccttgaaagaggaggggcctgccagggaagtggagtgcagcggggatggtacagggagggaactgcttcacctagcaggcagcactgtgtatatggtacctgaccccccttctctacctctccttgtctaggggttaaatattattattcccattcttcaggcagggaagcaaaccagacagcttcagttacccaaggccaagtgcccattgtgaactctgggagttctcagaggagctggctggaccccatggagctggcaaacccatgtatgtggaggtgacatttatcttctcagccaggaaggagcacgccatccagctgctgcccagagcccaggagaaccctgcagcactgtgattctcattagcctctgaaaggtgtgagggaaacatggaaggcagttatgcctggttttggaaattagggaggtttaatttaaaatatgtcagtttaaaacagctctcatcaaaacctactatggaacactaggacttattctgtctgaatggattttttatccactaaccgacctctgtttatctctgtcttccgccccttcccagcctctggtaattaccattagacactcaacctccatgagaacaactttttctagctcccacacattagtgagaacatgccatatttgtcttttaatataattttttatttttaggttttgtgggtacacagtaggtgtatgtatttatgcagtacaagagatgttttgttacaggcatgcaatgcataacaatcacatcatggagaacggagtatccatcccctcaagcacttatcttttgtgttacaaatgatccaattatactctttatttaaaaatgtatacttcaattattattgactatggtcaccctgttgtgctatcaaatactaggtcttattctttcattctagtttttttgtatcccttaaccatctggaccaccccgaagtcccccactatgcttcccagctttggaaaatgatccttctattctctatctccatgaattcaattgttttgatttttagatcccacaaataagtgagaacatgcaatgtttgtctttccatgcctggcttatttcacttaacataatgatctccagttccacctgtgttgttgccagtgacatgatctcattctttttttatggctgaatagcactccattgtgtatatgtaccacattttttatccattcatctgctgatggacacttaggttgcttccaaatcttggctattgtgaacagagctgttacaaacatgagagtgtagatgtctcttcgatatactgatttcgtggttattaatcccttgtcagaatatataaagagttcaaataactctataggaaaaaatgtaatccaacttaaaaatgagcaaaatatttgaatagacatttctcaaaagaagacatacaaatagtaaatagaaatataaagagttgctcaacatcactgatcatcagagaaatgcaaatcaaaactacagtgagatatcatctcaccccagttaaaaattgcttatatccaaaatacaggcaataacaaacgccagtgaagatgtagagaaaagggaaccctggtacactgttgggaatgtaaattagtacaactactatggagaacagtttggaggttcctcaataaaaaccaaaaatagagtaccctttgttctgttcaactggcctatgtgtctgtttttatgccagtaccatgctgttttggttactagagctcagtagtataatttgatgttaggtattgtgattcctccagttttcttctttttgctcaggagagatttggctattttgggtcttttatggttccatataaatttaaggattattttttctatttctgtaaagaatgccattggtattttaatagggatcacattgaatctgtagattgccttgggcagtatggacattgtaacaatatggagtcttccaatccatgaacatggaatatctttccactttccatttttttggtgtcctcttcagtttctttcatcagtgttttattgttttcgttatagagatctttcacttatttggtatttaaattcctaggtatttaattttatttgtggctattgtaaataagattacttttttgatttctttttcagattgttcattgttggcatatagaaatgctactgatttttgtatgttgattttgtatccttctactttactgattttttaatgcgttctaacatctttgtgtgtctgtgtgtgtgtgtgtgtgtgtgtgtggtctttaggcttttccaaatataaggtcagggaggacgcattggctcgtggctgtaatcccagcactttgggaggctgaggcaggcagatcacttgagcttaggagttcaaggccagcctaggcaacacagtgaaacactgtctctatgaaaaatacaaaaattagacaggcatggtgatgtttgactttaatcccagctatttgggaggctgaagtacaagaatcacttgagtccgggaggcagaggttttagtgagctgagattgtgccactgcactgcagcctgcgtgacagagtgagactctgtctcaaaacaaccaacaaaccaaagatcatatcatctgcaaacaaggataatttgacttcttcctttccaatttggatgccctttatatctttctcttgcctgattgctcttgctaggaattccagtaatatgttgagtaaaaacattgagtactaacatattactcaacatattactgaaaagtgggcattcttgttatgttccagttcttggaggaagggctttcagattttccccattcagtatgatactagatgtgggtctgtcatatatagcttttattatggtgaggtacgttctttctatacctagttttttgaggatttttatcatgaaggaatgttgaattttataaaatgttttttcagcatttttggaaataatcatattgtttttgtccttcattctgttgacatgatgtattatactgattgatttggtaggttgaaccatctttgcatcccagggataatctcacttggccatgatgtatgatctttctaatatactgttgaatttggtttgctaatattttgttgaggatttttgcatcaatattcattagggatatcggcctgcagttgtctttctttgatgtgtctttgtctggttttggtatcagggtaatactggcctcatagaatgaacttggaagtattcccttctccattttttggaattatttgagtaggattcagcagtgaagccaatcaggttccaggcttttactgggagactttcaactatggcttttatcttattacttgttatttgtcttttcagcctttgaatttcttcatgattcaatgttggtaggttgtatgtgtttagggatttttccatttctcctagattatccaacttattagcatatagttgctcatagtagctagtaataatcctttgaatttcactgatatcatggttttttctatttttcttttttttcctttttttttttgagacaccctcctctctgtcacccaggcttgagtgcagtggtacaatctcagctcactgcaacctccacttcccaggctcaagtgattctcctgcctcagcctcccgagtagattggactacaggtgcacaccaccatgcctggctatatttgtgtgtgtgtatttttagtagagatggggtttcaccatgttggtcaggctggtctcgaactcctgacctcaagtgatccacctctgccttccaaagtgctaggattacaggcgtaagccactccccctggcctcagtggtatcagttttaacgtctcctttttcatttctgattttattcggattttctttttttcttagtctgcctagaagtttgtctattttgtttaacttttcaaaaatccaactttttgtttcattgatattttgtattgttttcatttcaatttcatttatttctgctctgttatttattatttcttttcttctactaattttagggttggtttgctcttgcttttctagttctttaagatacatggttaggttgcttatttgaaatttttcttcttttttgatgcaggcacttggagccataaacttccctgttagtactccttttgctgcttttgggtatgttgtgtttccattatcatttgctccaatatttttttcaatttccttctgaatttctttattgatcctctggtcattcagaagcagattgtttaatttccatgtatttgtttagtttctgaaattcctcttgttgttgatttctagttttattctattatgaccagagaagatgcttgatagtatttcaagttttttgaatgttttaagacttgttttgtgtcataacatatggtctaccattgacaatggtccaagtgctgaggaaacaaatgtgtattctgcagccactgggtgaaatgttctgtaaatatctaccatatttgtctttctgtgcctagcttatttcatttaacatgatgacctccatctaaatgtttgagggggtggatatcctaattaccctgattcgatcattacacattggatgcatgtatcaaaatatcacatacactccataaatacgtgcaattattatgtatcagcaaaaataatctttaaaaaacaaacaaacctactgtagagcatttccacagagtcccatatctcctcctttaggatgatttcccttgaacacttcaatggttcttagaaggcaaaagcagcagctttggaagtgaatagacacagattaaagtcctgattctacacagaattatctgtgattctgggcaaagtaatttactcttctgcctcccacaagcctcagtttcctcccctgaaagattgggataaaaacctacctcaatacctctagatagaatgtacacctacagaataactaaataaatccactctttctttcttcctttcctctaacattcaatggcatgtatagtgtttgtcatacaatttaattttcaattacagttttctttctttctttttttgagatagagtctctctcaatcacccaggctggagtgcagtggcgcgatctcagcttggatcactgcagcctctgcctcctgggttcaagcaattctcctgcctcagcctcctgagtagctgggaactacaagcgtgcgccaccacacctggctaatttttgtacttttagtagagagggggtttcaccacgttggtcaggctggtctcgaacttatgacctcaggagatccacccacgctggcctcccacagtgctgggattacaggcgtgagccaccgtgcccggcccaattacagttttctaataagagacatttacatcatggtaatgctttgatgctatatttatttgtaatttattgtgtactaacagattatagctgcagcttatagatgaaagcttagtatttcatcatgagtttcttctatgttccatcaacaaatcctggcaagtagcagcttctccaaggccacctcctttgcatgcaacactctagcacatgctgcatggtttacagctccctgagctcaccacctgctgcctctgagtgtgtgctcatgatactccctcagttttgaagcctgtttctctgcccactcttgcctccactccacctgactaacatatcctcccttccttggggaagccttctctgacctcatcctgtaatggttccctaagcctgtttcacatgccaagtgctcatacacaggtgctcatgacactcacacttagaaactcattttccattttccatgcataggatagtaggtccacctcacctttacccttgtaaggggcctgtgaaacccagcaaatgactctggttcttagccttaggagatattgtggagatggctcactaagggatgaagatcggtgatgtccctagacctcttctctgtatgagtcacattatcttacatcccattaccctaagggccctcccgggagtccacaggttgtgccagcagcagccagctccagccttgctctgctgggtgaagctgggtcagtgtctaacttagtggcctccttggttgctggaaatgggaggagccatcgtgcatcagatgcttggactaaccaagtggggagccaggactcactctgagtggtagctttctaaatctgcaaaaactagagtttccagagccagggaccctggtttaatgtgctgctttgctggagcccgagcctctgatttcccttgttcagctgggcccatgataacttgcctcaatgatgcgaagagaagggaactcagcagatctaatgtgcctgctgctggaacctggctcctgcgtgaaacaggatgacatgcctgttgtagcaactgtcctctgagttgcagttaataaatctctggctgaatggatacgtggttgggattatacctcttgcatttggcaaatccataatgattcaccctcctgacctgtcactttcccagttctagtgagcattcttttctctctgctatttgtctaccttgaacacatttcttttcatgaattcaccaaaaatgaactgcaatttatttgcctgcaaatgcaagcagctgtgagtaccttgagggcagagattccgtctactcatctttacactgggaaaaacaatggaataaaaaatatattggtggccttaagtgtgtgtccagataaacttagtctcaaattcattctgttaccatgacaaggtaagatgagtaggtggatcaattttaaaggttctaccatctgtgcatctcattcatattaacatttgttaacaatgaactaaatgccactttaaagtaatgaccaacatctgtatagtgttttgcagtacatcaccaccttcaatattatctctgttttgggggcatggaaacttattcaggagccaacttgcatggaagcagcacagtatactgcttaagaggatgcactttgaagtgagacagactgaggtttaattccaggcttccccagctacatgacatgtgatttgggacaagttacttgacttgatttagccttagtttctgcatttgtaaaatgagaacgaagatacatacctcaaagcacttttggaaagataagtgagtttatgtaagtacccagaatatagtttgttctctgtgcatggtaatggtaatggtactcttgccacatacctcctagtaaatagaagagctagactaaggtctaggcattccaaatttcatgactcatctattgtaccagtttaatattacctaatagaacagttccccattttaaatttctattcaaaaccaattcatgcaatcaaatgataatataacaaggaatgctcatatttctatcttcatttacaaagttaaaattaatattccatctgtatattcattttgattggaatgcagagtgcctggtgcacagtgggtgttcaactaatgtttgttaaataaaattccctgtgaattctccccttgcaagtgctagacttggtaactgattataacaggagaatatcaacataatttttttggattgcctgaatcaattccattctttctggcccactttagggaaactgtcaatgacgaagaccctaaggaaactcatctgtggtccataaggagatgaatccccatgtctggggcatcatgttcactgtggcgccaccaactcagatgaccagacacaaatgaatttctcatggtactgtggtggaatcagctgttttgagttaactacctaagtgaatgttctatttttcccacttactattcatagaattctttcttttaatagcttttgaagaccctgtaaatcttttcaaatttttgggattaatccacttccactgtgtttccatggaactttgcttgaacctttattttagaacctatgtaattctgatttgtattaaaattctttatgcgtatttctgttctattagatgttaagctcttgacaatagacacttatataatctttgcacagagaaacatgcatgatgggtggggctgggaaggaaggagacaacaagtgagagagaaataaataaagagatgctatattgtgtctactccaagttcaggtattatgccagatgctttatagctatcacaggtaattctcatagaagagaaggatattactttctcggttttaccaaagagaaaacaggcatacagaggctaagcaacttcctccaagcaatgaagacagcaaatggtggagctagaaatagagaccaattctgtttagtttcaaaatccctgttgcttctccatctccatctcaatgttttgcacaagacagaggctcagtaagcattgaaacaagacctgataaactcacttgcaaataggaggtatgtgatcatagctaagcataatcaaatcatttaacagcttcaaagtacttgagcaatagaagattggtggcagcatatgtttgtctgaatacctacattatgaaaaggcaattcagttagatagaaagcaaagacaaaattaatgaattaagcttcatgtagaagcctagccttagttgctagatttgtgcaaaacaatcatcctagcatgctgttaattgttttaaaaaataaatgaaccggtagctattaattacgctttcatacatctgaaaaagaaaagaaaggaaaataagcaccaagatcaacacaaccagtagagaggctggtctgcattatacagtgaggagtcataaatcatgtgtgagtaaactttagagacgatcaatatcttgtttaactcttatgacaactatatagcaatagagcaatattgtttatacagctctttgtcatcttaacattatctcaaattcgcataaatttgtattctccaaaagactatacggtatatattattgcctgcatttcactggagaggaagcagaggttcaagggtgtaagcaacttgcccaaggttggccatatttaatgcaagagcaaagaagagaaatgcagaccgttaaggaactgcttttcttctaagaattttgatggttgtggtgaggtccatggagaaaagttgattactccagtcacattatccctgtctatgctgttccatctttcttctctctctatggccaatgcagaggacccaggatgcctcacatgtgaattcaagaaatggaaaatttcgctttatggtttaacataaacttggggtggaggggaatggggagaatgctgggctatgaacttcttgcactgcctgaatgtcctgacaacttcctttgtatgaatggccattgggggaaaaaatcaaggaaacaaaaaataatatgttatggaaaccatgtggttgcagtttcacatgatgggggtgggtttagggttatttgcttgcccctatcagttagccacatgttgaaaaggaggaaggaccacagactgcaacaaactgaatcaagactggaatgataatccctgacaatctttaatttgctaaaaacttattacattatcacccaagaggctggataccccacagaaaccaggttttgtcctgtgttgaaactgttggctcagatggagggataaaacaaaaagtttgtttggttagaggttgagtgcagagacatttgctgtagcttggtaataaacttgtctcctgcacaatggacagtagaatcgctgaacagctgttgattggtaaattagtatagagacccacatggtatctgtagaggagagacaatttcttttcccttgtgtctttcagacagatgtttggtgttccttgtgctttctttccttaccatctcatttctgacctttctttgtcaactgtgcattcagtgtggggttatcatttacctacctgctgtgcctccatctgccttccaatgcctgagcatgctcagattctggacatccaatgcagtctgatgaggatttgcttttcagagtccttttctctttgtacacaacacatcaaatggcaaatggtgactgtgggacccacctctgcaaagtcaacagatgccaggtaggtgttcggaaaaaagctgaattgaactaggcaggacagatatttgcaaattaaaacaactgctttcctgccagggttttcgttgggtctcgaaaggcccatggagagaagttaattacaccagtcaccttgaatttcttgaatatcacaagagggaaaggtgtgtttttagttggtttctggttccattgtgaacaacaaaaatgagcctgttaacagggcattatgctgcctgcatgctcccatgtatagacaggggtgtaagaactggaaagaaagctgctggaagtgccccttcttcattctaccagtagaaaactgaggtcagagaggctacatgcttggttgaaggtcatatagctaattgtggttgaggtggatgcggagactacgtcattttacccctgggttggcaggtgtcaccccactatattgtattaattttaatttctctgtattgggctgtaagactcctcctcctagtcaactagggttctatttttatttaaaatttaatcatatgatatttactaaataacaccaaagacataaaaccatataagtatcatgtgttatatatctatatatacactacatataacattcaacatcatcaatttccttattctttcaacaaatatttattttgggcctgtgtgcaaagcactggaatagagattgtcagagtttcaaaggtaaatataataaatctacagtggggtgaaaaagttgagaaattaaaaactaaagagtacaacccaggaaatgtagtaattgcagtttaaccaaaggcatttccatgtctgtaaggcaagatacttgaggattttcaaacatgtgaaatcctcactttaaatagggtttattgtaaaatcttagttaactagagggaattatctgggactctcagttgatcagaactgtttttgctagttctgctttgggagaaagagaccacaaagaatgcaggatggcatcaggaaagaggctgggttcacttccagattttccagaagttttaacttctctatggctcagtttcatttactgaaaaaggccaatgtgaagcttcattgtgtgggtgggaggataaaatgtgtgtaaagtacccggcccagagtctgacatacagcccctgcttagtaaatgcttattttcttagatctcatttctaaaaatgcacttcctgaggaccttcctgggcttgatccatactcaaagctgtctctggtgccatctacaccataagataaaacagtgaggaccaacattcgaaatgatggcagcaaggccccaggaactgtagccatctaaacacaattctgttctcactaatgtgttctgattaccaaagaggagcaatggagttacacattttggaagagctttttagccagagaaaaggaaacacatttttggaagggctttttagccagagaaaaggaaacacatttttggaagggcttttggccagagaaaaggaaaaagtatttgccacatagtcaaccagaagatttaatgactcagaatacagtggctacaagaattgtgggtgactgaggttttgttttatattaacagaacaaaggtgcctttggtgcaggtctgtgtttcttggcatcacttcctccaggaggtaaaggacccaagtgcctttactaaaaataatttctcacagatctgtccagtgctgacagagctcagggctgaccccagggaggcacaaggtgacctctgcatggccttcatcctcactcgtggtggtcacagggcatcagtgtcctgggcagttgtaggaaggaataggtgtgagtgtccacatactaatgcttccaaatgtgtcaaatctccctgctttccaaaaatagattttgtgggtagattgaagtgagagagaattcaaagcacaagaaaatcatggcataaaaaaggcacagaaagcagagctattgatcaggagctttattttatagaacggggcttgcagtctggaatgagacagaggtttctagtaaatagcagcagtgagactggaacctgggggtgctgatttttcatccagtgtttttgctgacatctctgtgatgacctggtccttcaccttctttcctaacgccacccgaggacccctaacatggagttagatgttaccgatggaaagcattgtacagagtctgtgttccaatcctgttctttttttttagaggcgaccactgaggcccagaaaaggggaagtgccttgtctgcgatctcatggaagttaatgagaaagcctgacctagatcacctgccctatcatagacccagtgccatttctactgcagtgtgcaaagacttcaaagaaggccagtgtgctcccctcacccccagggattgcaagttcaagtgtcctgtctgcactgtcctgaggccattctaggccattgtgcagagaaatctatattctatggggtgggggagatagggaagagattgagtcaacaaaacagattagtagacctattactccctagtcttagtacttttttaggtaatttgagtaaaactcatgaatcctagagcactttaactttgggttaaatgtaagtccacaacaatagtcacaaaattgtattgctctgggcttctctacctatagttagggtgtctggaactcttcaaatgagggaagtcattctcctaactttaatgtaacatctgtcatttcatcctcttcctctccaactccctgtagtcttgtccattgctaagcccgcttgcatccatgcaaggagccctctactttcacacagaccacccacaaggcctggagaggtcacagcaaagccagctcccacagcaattagagacattggcattttcttctataaactatagaataggtgtctttaaagatgaggataattgttagggtgacctccctaacaattattcagtcattattctcatctttaaaggcctcctttttactgccagaagcatctcatacacacttagatttctagccacagaccatctgccagctgtttctgccagaacagctgcccatcagaaggaagatggaccaagagagcctttgcacagctccagagtgcatctccagcatcagagaggcaggcagccttgtcatgggtagctccagcggttggtggatgacacagccaacttggacatgaaataggcactgagggcattaaagcagcatgaaaaaggatatccagttgtccacacagtacagtgtgctgctgtttctgtggacttcccacggtcaggcttcaaactctatcttgttctaaatcatagcacgcaggcgcatgcgcgcgcacgcacgcgtgcacgcacacacgcacaccccgccctccactaactcatgaggtgacctgacctgaggatcattgaatccagtcgttcttaaacttgactatgcctactgaccatcttgggggcatttagaaatcacagactcccaggccccaccacccctggcatactgaatcagaattatcaagaggtaaacccctccactcccttaaaaagaaaggaagaggccaggcgcagtggctcacacctgtaatcccagcactttgggaagctgaggcaggcggatcacgaggtcaggatttcgagaccagcctgaccaacatggtgaaaccccatctctattaaaaatacaaaaattagccgggcatggtggcatgcgcctgtaatcccagctactcaggctgaggcaggagaattacttgaacctaggaggcagaggttgcagtgagcggagattgcgccactgcacacctgcctgggtgacagagcaaggctccatctcaaaaaaaaaaaaaaaaaaaaaaaaagaacgaaatctatatttgacaagagtagctaatctaccacacatccacgactagcatctaggggctactgatcacagttcaaatatccacccctccctgtagtttttattgaagaggacacagtggctctgggagaggaagtgacttgccttaagcaaagccctgacagaaatgggactacgagactagaaataaatgccttcacctcttttgttttgctccttcgcacaatgcacatgccctgtcccttaatgatggccacagcttccttcctatttttctatattcataatacaacacatggacatttggctgggcaagcacatttattgatcaaaaatatgtaatcctccttccttatagaagctcaggttccttctacgttatttaggtgggcacctcaaggcgctaggaagaccctaaagctttagagatcagcctctgaaaatgtatgaatactgttgtgcatgtgcatctgtgtctgtttcaggcaagaaattctgtaactttcatacatgcccaatggcatttatctacatccctaaaatggctaaaacttctggtttacaatatccctaataagaggctactggtttgaaggagatggtttagaacacacacaaaaaaaatacaaaaataattttacttgagagatgcagcttaagttactcctttttggcacatctaactgtgccaggcatagtgaaaatgattgataaaatgtcaagatagaaaacacgatcataaaagctaatgcagcttgagaatttttttaaattggtttaaagttgcattgtcactagtgggaagcacaagtatggccaacccaaaaggcctcaaggaaaaggcaagagaagtcagagaaggctgaagacgcagacttggagggataataaaacattttatcagggcaggacttgagaggaatataaagcagtaagttttaattaaagttatgctagtacactaatttgggcaaccaagattcataattaaaattttatgccaactctgcgcatcaccaaacatttttaatggctccaggaagaacatgatgtgggtacaggatacattgcagtgaacatcaaggggagccagtcaaatgcacagggtggggaaacagtggggagtagctaggaagttttgtcccacaaactctgaaagctttcttctgaaaaatgggcagtcatagctacttggtcaaaggagtgtccaaatgtcttttgcaacacagcaaagtaccacttgctggtacttttctgctttccccaattcaatatggttcttggaaggcatgaatcacttctttcatctttttatcctcagtatttaagacactgtcttatatcagttatttagttccttaacaatgctgcaaaataaataaccataaacccccagtggcagataacaatttatttagtttataagtctttgaggttctggtgattttagctggatttgctcatgtttctgtggttatctgtaagtcatctaggcagctctgctaaactcactttgtttgctcatctatctggggatttactggctgttggctgatctagcatggtctttgttgggatgatggggcaacttggctctccaccatgaatctcatcctccaacagactcccctgggtacaatatcctaacatttccttggccacagcaagtcatgtggctaagttcagggtcaaaaggagagagtgctaccaaattatgtggcaaagagtatgaaaatagaatacagtaaataattagggcctttgatgaaataagtctcttacatgactagactagggtaaaggctcaataaaagtttgttgcaaaaactgagtatattatccaaagaagatatacaaatgtctcataggcacataaaaagaatggtcacattaataatgatcagggtaaagcaagttaaacccacagtgagatgccatttcattcccactagggtggttgaaataaaaaagtcagatgatgacaagtgttgatgaggatgcggagaaactggaagcctcatagactgcttggagaaatgtatgttggtgcagccactttagaaaacagtttggaagttcctcaaaaagttaagcatagagttaccttttgatacaacacttccactcctaggtatatgcccaagagaaataaaaatgtatgtccacacaaatgttcataacatcattagtcataatagccaaagggtgaaaacaacctggatgttcatcaactgattagtagaaaataaaatgtagtagactcatataatgaaatattattcagacacagaaaggaatgaagtaccggtacatgctacaacatgaatgaaccttgaaaacattacgttaaatgcaggaaaacagacacaaacggctacgtatgattccatttatgtaaaatgtctataataggcaatctatagagctagaaagtagattagtggttgtctaagtctgggtgggtcagagggaaatgggggtgacttctaatgcatttcttaatggagtgattaaaatgtttgaaaattgatcatggtggtggttgcacaactctgtggatgtacaaaaaaaacattaaattatacacctgaaatggaagaattttatggtgtctcaataaaccttctataaaaaaacaagaaccaaatgagataattcctttaaagttactcagcacagtaccttacaaccttggctaagttaaccatacttcataaaatctatgatgctatagattgtaagagacaccattatttaatatacaacaagaaaaacattaccaagttaactatgacagatcatcaattataagacatatcttaattttgaagatgttaaaatatggaaaatgtatattagaatcaatgaattatggcatgtgttgaagaaatagcatctgaagttaaatctattcaactgagtagatctttctgtcttcagattccatttttaggctcagatatctttcctagattaatggattttgggggtatccacctttgactcccagccttcatcaaattcggcaggtgggcccagaagaagtacttgccctctctggtcctacctggtgctctgtcattccccttacagctctatcctaggagtgcctggtctgcctgagaatctcttgtgtttttgtaggcatggatctctgagtgtggaatggacctgcctttccctcagggactggaggtcacttctgcctcccaaacccttcaagcatcttctctctctcctatgatgggatgtgatgaggataaacaaggaaagtgctttgtcgtggcaagagacatctggtccccagtggcagcttccacagagaagagagtgtaaaaccacacacatgttcactttcgtttgggtgaggagtagtcagagctgttgactaacggacaataggatgcatgaaaggtccacccatccaacttgtggtcgtcagtaaatctccagtcgcccttggggactggggagaattattttctccctcttgcaatttacaagtatcatctaggaaagataagacagtagcttcattgttggcaggctgtcatgggctttcttaacagcgtgagtgtgctttctaattttcacactagaggaaaaaaattaaaaaaaaacaggctcttcagttttgtcttccatatacgtgaatcttatatgggctgtagaattgttctgtggggacagacaatgaaaaaaaaaagtgtgatcagataccttcctcagaaacgaaatctagaaagaagagtaagcagtgtggtagatgctgtgtctacatcactacagttctcttccgctggcattttgttctggatgattccaggtgtagagcagaacttcatgaaaattatagtgcagtaagaagaaggcattctagtgccagacaacccatgttttatgatagggatctaacccagtgacaccaggaagtctttgatcatggtgcgtaagttgtgtaattcccatagtggttcttgtatttgacacatgtaagattttctttttgaagtctcaatttcattaccgaagacactgctcagagaacaattactgatagaccccaactgaagaagcttcctgggaaggaggtgcagggtgtggtctagatgcctacagttgggtatcatgactgagagacggcaaatagcattattcttcatctgggttccaagtggtggaaagtgactgcttggcataccctgtgaatgattctgaggctgctttagaacttcaggtggaaagccaactattactgatcatgcctatctatggatttagctagggcttggggtagagttgagttctgcctgttacactatgtctcattaatttcctctcagggagacagtatcctagcagggaatgatttggaatcaggcacacctggtttccatcctggttctgtttttcatcacatgatagtggagcaatttatgtaatctccctgaacttccattttctcatttgccaagtgggaaagagctcactctgccatgcactctccaaaaaggctttgtctaactcatgtgatcttcataaatgcctggcagagtcaatacctggaatctgtagaagaaagacacttttcacatggggaaattctttcccctcaggctagtgccttcagaccgagtctaatgtactctgcaggctctgcttggatcatttgtgcctgatgtctgaaaaaaaaaaaaaaaaaaaaaaacaaccagaagcactccctacatttgagaaaaaggacatctgggaattaatcctgaagttgggaggaaggttgctgagtctggattcagcctgaggggcagatggctagggatgtccccagagtgtccccacctccacttcatgtgcagatgacactgacagctgtggtgaggaagggccttgccatgtccatgccatactcattaagccatgatatctaacagccaacagctctgcaacctgtacctacttccaaggagtcaagctctatctgcttccaggctctgctgaatctgcctgtatttaagtgccccatttctttcccagaagtaataaaacagtcatctcgttgacattaagtgcggagtagcagacagcaagactcatattccaaaatctcaggaccctgccagttatgacaagacactcttctggctacagaattaacatgctactccgggtttaaatggggggattaggctaacacagagcaaaccagtttcttccttattttccctgacatcacttgagatctcccagaaaatggatagttttcaactctctgatttgtgcgcaactaggatcatcttgcaggaaggctgttcaaggagatgggtttggggtttctgccttgagaagctgataaggatggggttttctgcctagcgattactgtagcagaagtggccctaccttccatcctcctgcgatggggcctccttttcctgagcctttactgtcccaaagtagcagcaggactggacagctctgcccacagcatctcccgctcctgcattcctacattccaggcctcagctggagactacactttctccttactccctcttctctccaaatcccggcttctcagtctctctcctagacttgcaatctaatatagccaccaaaaaaatgtctgcctattttgaaatcatggaaaactgttggtttatttctaccttttttgggtggtgtgaaggaataagcaaagaaacactacattttaggaaaaggagaaatgtgtacaatgctgatttttaagttccagctttagtcagtttaggagcataaggctatcctctacgactcagtttgctaattaagtggtgattggaatattaaattttaaagtataatttagtcagacaataattaccagcgaactaattaaatttacttttcaatggttttcactttcaccgcagtgaacctgtaagttactgagctgcaaggaatcgagcatctttccttttgtcagagaagaaaaagcaggcaaagcaatgataatcaaagagtctttcttctacgttgtatttcgtatgaattgtgtagtagttaagtgcataggcccaggagctgagctatttggttcatggtatgacttggatactcactggccgtgtgatcttgaccaagttgctaaacctctctatcccccagtttcttcatattaattagtgtccatctcatagagtcactgtgcataataaattatttattatacagtttatagaatggtgcctggcacatatttaaatggtaaattagtcctatctatgatgatttttaacaatctttgtgctttctaaacttatctccttcaatgtcaagcctattaaaaaatacaaatttctataaattaatctggaggaaaaaagagaacaagaaaagaaagtcattgataacacctgccacacaaaattagccaatcattcataaattttgacctatcactgtccgcatttgtttccaatgcttctctttcatcctcttcacagaatgctgctcgcttactgagctctgagcaagttccatcccatcttgcttaccttgctctccccacaagatcctctcagactagactctccttttatttattgggtcttctcttttgaaactgctccctgtatctcattcatggtcaacttttgacttcaggtcagacattttgttttccccttattgaaataagtctctgtttctattaatatagactcccagtcttcactaagactctgccttagtttccattttcactcttgcagcttgaatagagcaccaaagagaacaaatgaatgtgcttttccaggagaaataaagttacacacatcccactgaaaatggaggagggggcctgaaaactttctagctcatttttactaattaaatacgtatgtgatgctatttatattttattatttagtaacttgtctttgttttattaccttagagaatgcaaaatcaaccataagggttttaaagcatagatttatagcactttctttaaccctctttttgccagaaggtcttaagttccttaattgcaaattttcccactttgagggtggagaactagggaagggagagacagtacttttcctgaactttccattccatattgctgggctcctctgtggggcacctgcatttcctgagtctgaggtctttccacattgccttgcagggttatgtgactgtcttgctgggacgcctggtctcagcggtccctttcagcactgtctgcatgattttcacagaaacatcttagttccagctacgtttgccactctgggcagttgtttggcaagcatgccatgttaacatgccatgttctttcatgtttctgtgccttagtgagggctttccttccatcttccactattctattcattaacttaataaacatattatgcagctactgtgtgctagcgattggggattcaaaggtgattgagtaaaagtctctcccttaagggagattttattataattcctgagaaggacaaatactgagtaaacaattgagtaacgaagacaattacagtgctgtgaaggcaataaccagggtgacaagataaggcagtggttctcagctgtggctatacatcagaatcctttggagaacttccaaacttatgggtgcctgggccccattctcagatcaatcaaatcagaatttctgggaatgaggtccaagttctagtattttaaaaactccccaagaacatttttaaaaacagttttattgaagaataatttacataccataaaattcacccactgtaagtgtacaattcgacagtttttagtaaattgcagaattgtgcaaccatctccatagttcagttttagaacatttccatcacccaaaaagcttcctcccacccatttacagtaactccccactcccacccctgggcaaccactgatcttctttctatagatttgccttttctagacaattcattccccagggagtttttggtgtagtctggattgaggacctttatgactgagcaaatgaggaagacagtggtgaagttagatctgaaggatgagaacaaaccagctgtgcaaacagtgtgtagaagagccctctggcagagggcatagcaaaggctagggcttggaggaaggaaagagcttggcccaggagcagaaaggaggccgctgcacttaatgagcaagggtgagagtagagcaagagtcagggtccagaaccttcagagctttgtggtatggtgaggagcttgagttttctcccaggagcattgggagatcactaaggggttttacatagcagtgtgacatacctcaatcctcatttaaagaattgagcagttttgtagagactatattagagggaggagaaagagggaagcaggaaggtcagttagaagactagttctatgtggctgaattcagttcattctttaaggcctgattaaatgtgacccattttgggaggctttctcagtgttcctacttttgcttccatagagctcaatttacactttcattaaaccaacaattatatgcaatcgttaataatctgtttacatgtctatcataggctatcaactcgtttggtggattgcatggggaaaaacatctcactgaacaagtaaattaatgggaaatacaataaacaaataaaaatgagaaagaaaaaagaattatatgttgtttttccttctatttctagcacttggcactatgcctggtacagtaacaggtgttcaggaaataaatgtttgttgaattgaatgatgcatctcttcaaggatcaagaccatgctttatgttttgaatccccacaacaagaagcataatttaatgtacaaaataggcaatgcataatttcatgttgcatacatgaatctaccttgagactgaattccatcagcacaaggaatataatgtgtgataataatgtatagtattcaaagcactttccttcattggggaaattgttgctgagcacctataagataacaggcattatgttatgtggtgctggctagtacctggtttaacaagatagtaagagttcccttgagagtgactgtggtcttgttgaaggaagctaaggagcaggggatcatgtaacaggcttgaagggaagaaagtcaaatttcattatccccattttacagatgagaaaaccaaggcagattaaagtgcatgtctaaggtattagttgagatgcaaacctgtgccttctgcttccaagttcttttgttggctagtggctcttggaaagaaatgccacgtctgggacacttgggcatttccctgtagaaagcaatggttgtctctaggaggcacaccatggtgaacgcttctgaagcatggaatttgcagctggaggagaccctggagagcatttgctttcgctgctttattttatagataatgaaactgaggcccacagaaatgaaaggactttctttcaggttacacaggtatttagtcagaaggccatgcattctcagagtgaaaagcccttattcattttattgttaaggaaatttagaaccagtgacatgaaatgatttgtctaaaatcacacaactaggaaatggcagaactccaacaagaacttaggtcctctagctcttagatctgttttctcaccactaatttgtagaacacttaaatgcttatatctgttgtccaccaaaagacataaaaatgttcatgccaccttttttaataatagcgcaaaatagaaataacaaaaaccttcctaagtggtagaatgagtgcttacattgcggtatggtgacaacatggaatattacacagcagtgaaaaagaatgaactactgcttcacaaaacaaacatgggtaaatcttaacagatacaatgatgtgcaaaagaagtcagacaaaaaaagagtccagactacatgatttcacttatgtgaaattcaagaacaggcaaaatagtgattgaggtcttaatagtgccagcggctatggctgatggggaacattagtggaaccttgcagggtgctgggaatgttctgtgtctggatctggtggaggtaacataggggtatcaacatggataaaaatctgccaatatatcctcttaagatctgtgtgcatttctaaatgcaagttatacctcaatagatgtaatgaatgaaaaataaagtttccactgtcatatcccattgttctcactacagatctgagaggtaagaccaggtttaagaatattaggcttagggaatttgctgaccaatctcacagcccagggaacatgtcagcctagccataagctctgcttgaaaaagctgctggttttcagtcaattgaagaaaggttttaaagtttcttagagagtttataaatgtgttaattacagtcatcaagattttgtattgcaataaatgtttatctaatgggtttaaattaggcaatttactcaatttgcttgttatttcctaattaacttctgaaatcctctttctctgacttttcaacctataccaatagagtttggatctaagaaattttattttccttttagcagtacgtatagctttttttcctttttcttgtttacccatccaaaagttctacaggcaatttcaaatgtacatctgcatctctgtttcttgaacttttgattttgttttgttttagggcaagactccttgtccctagaaaagcttactgctattatttacaatagaagctaatagaaagcaaataaatgaccaatgacaggaaaggctcaagtgaactataatgcatctgctagatggaatataatgcagccattaaaatacaacaatagcttggaaagtgcctataatattgtaagtggaaaaagcgagcaaaattgtccatatagcatgtctcaactaagcaaaattacacatgtctaaaagtaaagtatactaaatgtcaacaatgattacgtttaggtaggagaactagagtatattgttattttcctacttttctgtatttcccaaatttactttaaagaatatgcactatatttataatttcaaaaatgacatctttgaagacaaacaaaattcattttcaatatctttaaggcttcctttctaaatgtattctgtttttcaaagctattgagtttctcatattactaataactttatagctttaaatcagtaaactgaagtttattaagccctgacttggcatctagatcttctcatagcactatgagacctaaataaaaaaaaaaaatacaatgatgcaaataaaaggaacaaaagtgatagggaaaaaatagaggctaatgtaagaatgaaaacagtttattttgacctattgcttattagacccttgaaatcagttttctcataaacactccctgatgaaggtagatgtgatcattcccattcatttattccacagacatttctaaacacctattatgtgtcaggcactgtgttcaatgctggggttacaaagataagtaacataccaacattgtggctatatgtcatttataccaaaattattatacctaagaaaagtatagccctttatctcaaggaagcttgcccacagaagagatgcaaaaaacagattcagaaaggttaaatgacttgtctctgtcccacagaaggacagtgctagagccaggatttaaattaagatctcttgggctttactaacatgctctttgtagcacatccagcagcttctctgcaacatcctggtatcgaggaccatcatatgatacagacgacggatgctgcaggactgacaaactcctcagtagctggcaaagctttcctgaacaatggaggacctcactgggctttatagtgggtaagatttagatatgtggacatatcggggaagatattaacagcaggcaggtgagaatgaccccatgatcatggtgctggggtgcagaagggaaggatgtgctgggttgaggttgggggtgattttccttcagtgaatcacaactgagtccagtgaattatgtcaaatataatgcaggggctgcaataaggaatgacaaagagctggcctttgattcctcagatattcattaaacatctatatttggttgggggcaaggaatgaagtgatacatataagccatcatccatcttggaagggaaatgggtccataatcagatcatgaggccaaaacatgggacagaatgctgtcatttagctttcagcctcaaattgtcacctctgcagaaagacccggtctgtagtagtcatccagtcatttcccatagaccccaatcttaaatctatacagaatattgatcaacattggttatgtttctcagtttgtcacttttaaacaaaagtgattgcttatctcttttcattagaatataaaatccaagaaagcaggaaccatgtctgtctgatttctagctgaattcttagatcctcaaacaaagcttgaaaaagaaaacattcactaaatatttattgagttaattaagtgatttttttggagcaccaagaagggtttctagcctggacaggaatggggcatggatgtcagagaaggcttcctgcagaaggtggcagtgagatgggccttaaagtatgagcaagttctgtatggaatcagggcaagagcgagagggctgagggaagagaggaagggcattccaaggcacaggcagacaatggtggtgaaacgtgctatgcagaggagctgggaagtgtcaggcaggacttgcctaaagatgcagctcaagaagaagccccggaagcttccattttatttgaaggacaaaggagatcaattggagagtttgtaagtggagatatgacatgatcaaatcagcatttaaaaaaattcagcagtatggaaagacacattagggtgacacaagattggggatgaggttccctgttgagaaaaagtggccccttaccctccaggagctgggctgggactatcagccaggacttgatgcttgcttgatcaaaataaatattttctccaaccacaccagacaaggccactgcaattccaatgggtcaagtcaaaaaacaagatcaccctataataatttctgaacacaggttgggcacagtggcttacgcctgtaatcccagcatggcagattacctgaggtcaggagtttgagaccagcctggccaacatggcgaaaccacgtctgtactgaaaatacaaaaattagccgggcatggtggtgggtgcctgtaatcccagctagtcgggaggctgaggtcggagaatcgctggaacccaggagggagaggttgcagtgagccaaggttgtgccactgcactccagcctggatgacagactccatctcgaaaaaaaaaaaaaaaaaattctgaatgcaaacaaaaagcatgaacatcatccacactataaaaatgaccaaacagtcccctttcttggctaatatgagtggctgatttttttattatactttaagttctagggtacatgtgcacaacgtgcaggtttgatacataggtatacatgtgtcatgttggtttgctgtacccatcaactcatcatttacattaggtatttctcctaatgctatccctactccagccccctcccgacaggccccagtgtgtgatgttccccaccctgtgtccaagtaatctcattgttcagtttccacctatgagtgagaacatgtggtgtttagttctctgtccttgtgatagcttgctgagaatgatggtttccagcttcattcatgtccctgaaaaggacatgaactcatccttttgtatggctgcatagtattccatggtgtatatgtgccacattttcttaatccagtctatcattgatggacatttgggttggttccaagtctttgctattgtgaatagtgccgcaataaacatatgtgtgcatgtgtctttatagtagcatgatttactatgatttattagtaatggtttactaattacagttttaaccctgctgcattcttccagctgtgtagataagatttactaggatatgcaatcttagaactagccccatttcctgacagcacacagtccagagtgaagccctgcttccttgaactgtcctccaaagtatctaaatctgaatcctgtaagtccctcctagcacctcttgctgatatgcctcatgatatctcacactatgcattgtccctcatagaaacagcaatacactcaacctgttcaacagcagatgtgttcctgcctttgtctggaaggcaatggcaccgctaaaaggttgctgcagtcactaatatgcggaagcccacctgtaccagctcatgctgattgccaaatttttaggaattttgcaagccaagtattaaacctagcactactacaaattaagttatataaacttataattgaagacatttaaagatattaaaaacaacggtaatacgtttactaattcttttcataattttacgtttttttctggagtacattagcattggttgcatctatatggtagagatagcataaaatggtgtcctactgtgcatctgtttccaatcccatgtttagtgtcatcatgttgctgtgaaattcaccatagtgaaaatatttacaccactgaaattggcaaacactacaaaccaaggcttctgctgtgctttctccagttgattggtaaacatttactagcaccccactggctacactaatccatggatgttgaggccttgaagaagatattgagagcaaagctggagatctctggatggattcaagaaatgtttaggtgataaggtaattgatggagaaggaaattaattatctaaactcttctcctgccctctggtataaaaagtataagcatcagattttctttgtctaaggagtcctatctttgggcactgagatatccttttgtaatgctgtcctgagtcccacctgctctcaggctgattgcctgtctatggcttgagtacaaggaaaggcaagaaatagctcaggggaggattgctgacagcactcttggagtactgatgagagccatcaggatgaggggacctgcttaaccatctcccaaatagctccccattttcaactaagagaacagtcacaataggtgagccttccttttatgtcagggtctgtttagaaatacacatgatcaggttatttatttactttaaaaagttcaattggcattaaaatttcacttggactaaatcggataatagaagaagcacagagtgaacagaaaaagcacaaggtgaatagaaaagagggtcatagataacagattaaaaattataccaccaggagaggaacaaaagcactgtgctctgaaggaagcagcttcctctagtgatggtatctggcacattaatagtccaggtaattaatggttgtaaaacacttcaaaagcataaagcactgcatcaatgctgagacataattgtgccattatatcagaacgtggagcttcagtactgcacacctacggtgcaggtttttaaattgctgcagtcttggcataaatccgttggcttccatcaggcgctggcctgccccattcacccaggctgctgtaaggggccacgcctgtgcttacatgtgaaataagaagtggtcagcacatgcccctcctcccccatggagcactttcagatgatcaggacctgttcagaactccagtaactcactctcaggtgaccctaaggtcagtgttattttccatggttgtttgcatgtttcacctgaaggtctaggatcattccacctgcttctcttgccttctgtgaagggacctgcccatgagagagagctggagctttagtggattctcgataaagctgtgtgcaattacacagtgagggtgaaagctttcccctccgaatggctccactcccacactagaatcctaatgtcccataggatataccggcttttccaaccactcatgggaagcaggtattataaaaaaaattcctactttgtagataggagaataaaggctcaaaaggtcaagtcaaatgcagagggctcaagcctagctctgaccctaaatctagcactctttcttcaatgtttccaagctctcaggtggcttatgccactgtttaattttctactgccttgtttcctgctacagtcaaaatcataaccatgccaaggacagaacccactgacattgcagagagtgcttttccagagctcagagtgctttggtatttgtcattttaattaatctggtctgtgacttcatttctagctgcatgatcttcggcaagaccttaacctcttggggcctcagttacttcaattgtcacattcattaactcaacattgaagtaaggtgggcaaaattttattagtattaaattattaataaatatgcattaataatgacctcttaaacttttataactcttcagagtttacaaagcactttctcaagtgtcttcttaatctcttcttccaacagctctggaaggtcgctaaggcaaatgttactactccagtgggagtgtgaagaaattgaggcctagaggctccagaggcattttatataaaatgtgttttgggaaaatattagtccctcaagatactctatgaagaaatgtacgagtgggaaatgctatgttgcctacttagaaaaaagggcaaggcaaattaaaggctgttgtaagtcctgcggtaaggaaacctgcttaattttgtttaaatatgtttgctgaaacatataaccatgaaagagaaactgctttctctgaacacctattaatatttcataaaactaggttttctggtgctcctgttccatggaacccttagtataatcaagactaagcaatttgatcaaggtcatgtgcctggcaaaaccagttcttctgtttctgagtcaatgtgaaacattttacagccctctgtccataacaaatttaacaaccttttttgttcagtttcctagctgtttttgctcagtggagctgggcaaccactccaacccccattaaattccacttgttgccaatgaaatgctaagttacctgtactgagcaaatttcacatcactgtgtagctggcccagattctctcttgtctctcttaaacatccggccaaaggtacaggggtgggagttcagggaaaggtgtagtgaaatttctggtgtcttgttggcttttctttctgagttgcgttgaacattccagagacagtactaaacaccaacaattaggtaaagagactaaaacagcagtgctcatctagaagcagctccacccccgcctcctgcctggggacgtttgaaagtatctggggacatttttggctgtcaccccaggtgggtgctactggcatctagtaagcagaggccagggatgatgatgaatgccctatggtacaagggaaagccttctacaacaaagaattatcctgcacaattatcaaaagtgctgatgtgaagaaaccctggactaaaggaagtgagatggtttgggttgcgtgtccaattattgaggcagcttggattactgaagacagcattgttccgttgcctgagagtcagtgttcaagccctgcttcaccagagtgagaaagacttctggggctcactgccacatagttctcctctaattcctggtacagataaaattcatacagtgaactcctccctgcctcttaccatggattggtagagtcctgtcacttagtgcctggcagtgagctgcaggtgaaatgatcaggcccctaagccatccatgagaccttccatccatgctcctttttaccatctgccggtaaaatccaggggagaattctgaaatctgactgagataatgaatcaggagttcttaaacttaagtccctagatccccaagaggtcagtggatactggaatttgagagagaaaaaatgtcctctttaaaaatttatttttaagttttgcaggtacacagtgtgtgtgtgtgtgtgtgtataaaaatatataaatataatgggatacacgagatgttttgatacaggcttgcaatgtgaaataagcacatcatggagaatggcgtatccacctcctcaaacatttatcctttgtgttacaaacaacccaactacactcttgtagttattttaatgtatacaattaaatttttattgaccaaagttaccctgttgtgctatcaaatagtagatcttgttcattctttctaatttttttgtacccattaaccatctccacctccccccggccccctgctaccctttccagcttctggtaatcactcttttactctctgagtttaattgttttgacttttagatcacacaaataagtgaggacatgcaatgtttgtctgtgcctgacttatttcacctcacataatgatcttccattccatccatgttggtgcaattgacaggactgcattatttttcatggctgaatagtactacactatgtatgtgtgccacattttctttatccagtcatctgctgatggacacttaggttgctccaaatcttagctattgtgaacagtgctgcaatagatatgggagtccagatatttcttcaatatactgacttcctttcttttgggtatatacccagcagtgggattgctggatcatatggtagctctgtttttagttttttggaggaacctccaaactgctttccatgaaaaatggcctctttattgtcactaacctctaattgaaagcatttttttcattatgaatgtaagcaccaactattgtagtgttattggtatccacaactaattttctaatacaaatcagaaatacttattacatcaactatctcaaaatattatttttactcatcactactttgtaattatagcagttattggagcagctgaaagatcttgttttataatgcattgatacagaagcacacatattaccatattacaaatttgttgtatattttattcaattacaaacattattcagagaagggtccatagccacaccagactgtcaaagaggaccacggcacaaaaatattgagttgctgctcttggtggaaggagcttggttcctggatgactgcatggagcagagtcctcccttccaccaaagtcctgtcatcccacattgggctatagtataagcaaggaataagcctttcttgtgttatctactgagatattggagatgtttgttaaagccattagcccatcctgactggctgtaattaaccttgccaaaccctttaattgttctgagctttggcttccaaacttgctcttagaaagaatcttatccacacaggatggctgggaggagtaaatgggagaactggtatggaaatgcacaacagatgaagggttttttatggatcatcaagtggggctgctttttccccaagccagaggtcaacaaactaccatccacatgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttttctcctgtaagtgatggtggggagggatgcatggcagactctttatgcagataaaaagcctgggaggatgctaccctcctcaggctcagtgggatgcctgaagctgggcacaagggaacacacagcatgcctgccacctacgaacactgggccaactgaatttaaagccagaacctgtagcccctttgtcacttgcttgaactagttaactgtatcgatgcatacatgggtttgtttcctttgatgaggtaggccgacatcctcagatctagaaggcatgcatggggcagaagaccaaagctggtttgtcccatatctttgcagtggtacatcccttcatatcggtaggtagcagtgcagaagatatgctcacgcccagtctacagataaggaaactgagtcacagaggggttaagggaatataggaaggaaactaccatataaagacaagcatagtcaaagaatttgcccaccgtggtgtaattagtaagtggcagagctggaattgtaacctagcttgattccatgtccagcagtctatacaacccaacattgctttctccatcattttcactgctgttagtatcatcatctgactgcctttgtgtagtgtatgtgtttgccaagtatagctgtgacaaggctgctgccagaatggtctttcaagtgatacaagtcaacccttgtttatctctgctgttgaattgctgtgtgatcctaagtaagtcacttaacctctctgagcctcactccattcaactgtcacgacagaattgtaatccttatcttacctcactttgtaattgggaactcatttaaataagaaaggaaataagttagctgagtaaatctttcttttttaagtctgcactaaaagaaagttatttttctttgcaatattcacaaaactgacagctgccaaaattagcatctgactctttttatttaagtatatcttatttgcttgtattaccgcagcacatcgtagaatgatgtcctaaatgcccttccaacgctggcattacatctttctaaaccaacccttcttttagctgttgaagaaacaagcatctagggaggcaaaaggatttgctttgtgcctcctaggaagtatgagctgagactagaactctgatccttggttcctagggccctgtgttctccacactacttcactgactcctgaaggagggatcgctttcgtgatgatggttctctgagtgcagaagtcacacctaatgtgttccttttctttcagggtagatgtgcaacattaaattcaccagctttggcttcagaaagacctgggtttccatggtgcctctgccactgacaaaccatgggatattgggctcttttatttccctcctgcagattcttagcttctccatgtgtaaaacaagaataataatagcccttacctcacgggtgtcaagaggttaagtaagatgatgtggataaagcatgtaatgaagtccctggcatgtagtaacactataaatgcagctgttatcatagttactgttttagctgcccaacataaggctcccacatcaaaagcctcctttgtacaatttactcatggggcaggaaagaggctgtgatgtatcatcctgaggtccataaaaaggatgctaaaaaaacaagtcataagcaaccatggctatctgcccagttttataattgagaaaaacagcatcttagaaaatcactgctagtttaggtctcttgcttggaattactaaatgtgaatttaaatatgtatttattttgtgtgctggtgtcagcaagtgtgggtactgaggaaaccatccatatacactttaaacttcctgagttagatctcttgtggatgccttctttctggtcaagcgttggtattggccacttgatttaatctgcacttggggcagcctccttcctggccacagagctgatcctcaccttggtggctcccgagatccatggcaccacaaacccttactatgagatgtcttgaagcattaagctttgatgaaattatgcccaggaaacaggcctcttagccactgacagaggtcacaggctcgctggcttacacaaaaccaagctcttggcagagccctgcagggatgggagctgtttggggctaattagcctcattaagaaactgctgatgagctaatggaactgaaatgtggtcaccttctgaagtcacctagcagatttgcagcctaaaaataaagtaactttccagcagtttcccaaggccccaaagcctgtgctcatatttcttctaagaggaagtagtgcaggtgggattctctttccagctgggccagagcctagaacacggaggggcttccagtccagtgaataactctcccctctcttcctgttgcctccagactcagcctccagagctctactcaaatcctgctccctactgggaaatgtatgctctctgtctctgtctttctctccctctgtttctcgatttctctgtctctgtctgcctgttcctctttgtttatccccctctctgtctctccctttgtctctgtctctgtctgtccttgtttgagggtttactctgtgctgagttcccatatacattttctcacttaatcattataagaacctgatgaggctgttactgccattgttcctgtaatgtagatgaggcacagagaggttaaatgacttgtcccaagttccacagcttgcaagttgccagaatttgaacccaagaagtctgactccagaacatgaacctgagcgccgcccccccccccccaggtaatacccccttcaactgtgagttcttagaatgttgtttgcacctacacaatttcccactccaatgcgttcttttcttgtgcatgtacagtgaacctccccaactgacacacagtgggtattcagtcaatgtttgtcggatgactcatggggtataatcttctgaaggcaatgaacttgttttataaacctggggattcccctacccccccccccccgcccgccgattttcctgtacaaagttaagctcctagtttgaacctgttctctctttctatcagatagtctttttattgagaaagttctttctcatgtctagatgaaatctctgacgcacaaacccatttcctgtattctgaatcatatttgaaaatttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatctactcatttagagcacgtcccagaattagtgtgagggttatgttagataatacattgcatctaacttgtacatcagttattattcttaccacaaactggatgcagaagtgtttctttttggtagaataactgagcagtgatttattttggatagcaaatccagtagaaatcttgaggattgttaccccaggtggaactccttagtagaagagctgtagctgattaatttcttcaaagatccatgctccctccctcccttaattcctccctccctccctccctccctccctccctccctccctctctcccttccttcctccctccctccctcccttccttccttccttcctttccttcctcccttccctccctccctccctcccaatatttattgtgcaatgccaggtactagatgctaagtgctggatattcaggtgctagatgctgggtagatgaaaccaaatgaaaaagctccttcccttcatgggagcccacagttaaaaaggaaatagagacaggtgaatccctaaccaccttgaagtaggccaagtgccatggacaggtggaaagagggaaagtcaatattgaacgaccatccactaaaccttggaatcatcactgactcctcagtttctcttatatcttgcagtccatctatctgcaaatcatgccagctttactctcaaatacatcatgaatctgatcatttgtcgtctccccgcagctgctcccttggtccaaatgattaccagctctccccagaactaatttgaatagcctcctaattggctttcctgcttttacattcactcccatccagtctagtctacatccaggggtcaggaagaacttgtaaaaactgaagtcagaacatgtcactcctctgctcagagctcctcagtggcttctcatttcactcagtgtaaaatctgaagtcctcacaaggttctggataatctggtcctggatactctctgctctctaccttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatgacctgtggtcacccctttccagcccagcccacacacatcagcctccttgcttggccctgatgacttccagcacacactcacctgagagtttttacagagactttgacaccaatcctggcctagactatcctttctacagatatacacatagatcatccctcactttctttaggcctttgctcatatctcatattaaaaaccccatccttggccaggtgtggtggctcacacctgtaatccaagcagtttgggaggctgaggcaggcagatcacctgaggtcaccacaactagcctggccaacattgaaaactctgtctctactaataatacaaaaattagctgggtgtggtggcgtgtgcctgtaatcccagctactcaggaggctgagacacgagaatagctcgaactgggagggagaggttgcatgagccaggatccaccactgcactccagcctgggtgacagagcaagactttgtctcaaaaaaacaaaacaaaaacaaaaacaaaaacaaaaaaacaaacaaaaaacaaaaaaaccatccttgaccacactcactcattattactacctgcattctcccattattactactctcctgcttaatttttctggacatatataaattgtttaggtgtttactgtccttcactccattagaatggaatctggtttggttcagtatttctagtaactgtaacagtgtctggcacatagtaggtactcaataaatgtaagtaggaagaatgtgtagcatggtgcactagagacacataaaagggggcatctaactggacttggtcatgggtccctcttggaaatctgctctaggttttgaagaattgaaaggtgttaggcaggcagaaaaggagggaagaaggtatttgatggggggtccaaatatcatgtgagaagactcaaacgaatgaaaggtcatgattcatttgtgaaatttttggtgcttctagatggaatgacagccagaatccttctacaatggcctaaggaggagacacagccttactcaactgccctcccccacccacttttgctgcttaataatccactagaggttttatcaacagagagattttaaacatttccccaagccctgccttttctaacctgggcagcgctttatttatttacttattttacttttgttttcctttttgtgttttctctgatttttaacagacatcgaaagtccagatgaagaagagggatctttcctttctttacatgttgctgtgctgaaagccaacagccaggaaaggagttagcgaaatgcccaggcggtcacatcagaacctcagcaaagggccacatggctgggccaggacagatcagcagactccaggaagccacggtgggtgtatgcactcaagtcactgcagttcagagtaaggagcagccctccagttccagccaagggcgacggctttgctggtgtcctctactcgtggttggacgctgctttggaaaggaatcatgttcactttggataccaactgccaaggggctgctttccagttctgcccatcatttttactctcttctgcatatctgggttctcctctgttctctcgggaaggaacaggatgaagcctagttgtgctcactgtagagggagaacagggtggaacttttctgattactccattttccaggtctcagagccagagaccttcatgctcccacagctgaaccagtggatgatgacaactcttaagacttgaacactgtgtctgtgcagttagtgctcttagtggtagaattgttagaactgcccagagttctggagtttcagcttcataggtagcagcatagccatgtctgtgggtcccaacctgtcattccaaacttttctttttctagctagagcaacataaatcatttattaagtaattaggctatgttaggcattgtgacacattagacataactgtctcacttattcctctttataacctttctcaaagcttgtccttctttcttacccctctctgctgccatcactgtcactccaccctggtttatttttcttctaagcatttaccataactaggctacatgatatttcatattatttttactgatcattgctctctcaaactaagatgaaaacatcataacaatagagatgttttgttttgttaacttatattgcctatgcctcaataacataataggtgctcaataaatatttgttggtagatgaatgaacatatgagttaggtttcatggctcttttactgagaaataaaccaaacgtttaaaaaggagataaattacccatggtaacgtattcaggatgtggctgggatcagatctgagccaggatttaagcttgtgccagatgagttcaaagatctcatttaatacatcccttcaggtagtttacactctagcagggccagggattggctggtgtggggaagagaggcacccatctccctgcacaatttcaaaaggcaccaacattcaataatcaaaataaataacattgtaatgtacttaaaataaataacttgcaacgtgcttaaaataacttgtaatgtacttaaaaattcagaagttttaatgccaaaaaccctaggatgaacaaaactttaaaactttaaataaaggcaagatcagtcttattgatttttcccttttgcctcagacttcaatatggctcagaccagcactgatctcatccttgtttaaaacgataacaccctgaccccagccctgcactctaatcatagttatgcgttgaatcttttattctttgggcatttcctccctccaggcctttgggcaactgctcctagactttgggatatcggcctcttgaaatatgtgcacgtttgtgtgttttatctatattcttaaactatggtggactgatcatataccactgtgtgacatctctcactgttgcttcataaattctgacttcctcactttactaagcaatggccatttgcaggcgtggccttggcagcggtgctggctagccgctggttcggtttgttagtaccactgtctatactgcctgctgtttaactttcggatcattttgttgcattttctttattatttagtgatcatgagtggaaaacaaaaatgaaagagctgaatctagcaagaggaagcgtaagtctgccaatctaatctaataggaacaaaaatggaaatcattagccatgtcaaaacaatgctttctcagctcaatcagagcctcgctgcattttcctgttgactgtgtgtccacatgtgtaagaaaagaagaggattaaagaatgcataaaactgctgaaggtatattatcgaaaactgtgtcaaaagctgaagttaaattaggctttgatgcttttttccttcttttttttttaactctgctgggaccatctttgtaacattattaaaattattaatgtagaatatactctttaccaggccctcttctcagcactgctcatgaattaacttatgtaatcccataagaaccctatggggtgtgaaccttgtctgttttatatgtgctgcctattatagatgaaaaagcaggcacagagaggttaagtaacttgcccaaggtcacacagctagtgagcatcagagcacggacttaacccagttagtctgacttcagaattccatcttttgaaccaggaacaccaaacctgttacacaacatgtacatcaactggacttcacatatttcacttttgcacgtttctgttttcaattgcatactcattacatacaaacatagtgtcttgcctatgactctctcccatttttgctcatcctaacctttgccttttctaaggctcagataaaagctacctcttccatgataaaggaaacacaacaaaatgattcgaacgttgcacaacaggcagtatagacggtggctcggacagactgaaccagttgccttccctgatactccaagataggacttctgtatcaatcttagcatgcccatatgcccatagcacttaatttctcaattttctcagcgtactttattgttctttcactctacgcacttataatctgtcttaatacattgtgtgtatttcatctttgcattgtgcaaaatagcaatggtaataactacttgctgaagtgggtacagaggaatggggcctgcccagtagaatggcctttcagctcctgggaggcctgaggtttctgtggattttctatgacctttttatactgcggatggaaattataaagtgctatatacacgtggaagaactgaagtgtactatctactggaaagtgaagcagcaagtgactaatgacaacgtcctttcatggagatgacccttctgggacaccgtcagcaaagttcatcattgacatggtggaaattgcaccaggttggttccgggaaattctgccttcaggttccaacgtgacctttccagctccaacgtgaggaaagcagcttcttcttgtgtaaaatatggataattactcctgctctgtgtacctcacgggctgttgtgacagcaaatgaaagatgatatgaaaggacttcataagctatgaagcaatgaggcagttggaaggtgaccagattttccctgggtggatttaatcatgcttaattcattttccatgcatccttcagagccctgcttgtgtggacattcagagttacccctagctcctgcctccactctttcccacctgtttctcctctgggaggccggcctttagggtcagcagtggctcccttactctcaggctgctagttgggtttggccaatgaggggccctggcaggagactggagtgaggaaggaataagaagccagggtatttattctattgtcctctccctactcagggtctcattggtctggctatgtccctcaactgaggtcactgctgccctcaaggcagccctctctacctagccctctcattcaaatagctaaaggcagtgacagccagtgctggacactgcattctccctgtggtttctctacaccctgcacacacgtttgcaaacagtccctctaccaaactcgcctcaagttctcctaataagtgctatcatttcctactgggaccctcatgattcatctcctcaaggttttactttctttatgaggccttcctagcaaacctggacccagcagacagctactccacctggcactgaactcaaagctctcaccgtttttaccagttttggcaaagtgaataccatggaacattcaatctaatggatagtagtgacataaaaattattttccaatacctttgggagacacaaagttaaacagactatatcactaccacccccttttattttcaatctgcaggacttctcagagcatttcatttgcttttgtgcatactatgcaccactaggagagaaacacgcacacacacacacacacacacatacacacacacatacacacacacacaattaaactgtaagaagcctattataaaatgtatcactaaagatgttaaaatgtgaaaaaatgttggtcttagaattgatggaatatgataacatgtagacattacaagctttcttacttgaggaacactttttggaaagaaaatctcacagaactagagctttagggacatattttggcaaactcttacaccttttactagctaacagcatacacagtgtctatatatttatttcatgattgcattaaagtagctatagatgattaatctcttgctggcaggtaatcgttactagtcccatctttagacatagagttaacacatcctatgggctctgtgagtacttggtggttgaggaggctctgtggcacagactggctagctctttaccaagcctggttctgtttcctcctgtacacaaaatgaactgcatctcccagctttccttaaacttaggtttggccatgggagttctggctaacagaatgtagtcagaaataatgtggaccaccttcaagcctggcccataaaactctcccctttttgttctcttctctcatatgctggcaggatgtcaacacccaggacaaacttggaaaccttgcattgaagatggcagccacttcttcagcctccatctctgaatacatgaacttccactacacccctcttcccattgccactgtttggacttagagtgagcaagaaataaatttctactgtacaaagtcactgagattgtagaattcatctgttactgtgtctggtgttgtacaaactaacacagcctcttgtgactagggagttaggaggtctaagggggtggcctatggctgggcactgcagacagtggttttcgtggaggttatatacagccttggcctcttcaaactcagaacatctatctgcacccagtcttctctctgaagtctcccacatgtcctagctagtctggatattctcttgcccattcttcctgctcctgtgcacataactgtatgcaagcatttgttaaattgctttcatttctctgcatacatgttgatcttcctcctctgaccatgagtttcatggggtcagagaccttaatgtattattgtccctactcttaatgttttatgtggggcttggcattgggtagatactaaaaaaaaaatttactgaatgaacgaattcctaggacttattatagccaaaataaggcatcccaaacttttactttcccacatatttagactacctcccagtaaattccaccattgaaacaaatataaaaactaactcaagacactccaagaggaatcaaagcttcaagaacaacaaacatggaaaacaaaacaatttttatgctcaaactttccagtagggtgctgtcatagctaaatgcattttgttcatggaataaatctttcaaagatttactggtaaacatttatgttgagttgcttcatcttttttgtctttttctcattaataatatgtgaataataaaaatacctcattgatatgaagagttatgttaaaatagtgcatggcacatagccagggctcactaaatgttagctattttcattacatcacaggtgaagagtttcattccgtgattttattaagatgtctggttgttacttaagtcagtaaaccaccccccaaggtcagttccagctcatagcctgtgtttgtatggccctgcaagctgagaatggttgtcatatttttaagggataaaacaaaaaaacaaaggagagcaaaaaaagagcatgcctaaaatatgtactgtttggttgtttacagaaaaacgtttgccaatccttgcctaagggtaacagctcaaagactgcccccatggatgtgtctggaatcctctaagcagcccattgcagcttccctgcagtttcctcctttaatttttaaaatgtttgaaatctttaccaagtccgtagctttggtggctgtaaagattcattatacgtatggattgtccaagctgttacagaaactgaacagtgaggtgctgaggctgtgttccatgggggttcaaaagattacccctgtgacatcttgcaaagacagtgccatgcaaatgaaggcagccatgaggagctacgttgaaaagcttcatgctaatacttaggaaaaggagtcatgagggacgtatgcaattgacaatcagtacagccctctaagcagaaagaccacaaagggaaagagaagggaaagtagcatttacttaggtacctagtatatgccaggcatgtgctagatgccttctttagcatagcagcattttaattctcatacagtccagtgaggtgcttataattatcaccccagtttttcaaacaaggaaactggtttgagcaagttgtttgctcaatcaaggactcattcaaacaggattggagtccaggctaggctgatttataagcccttgttctttcctagaacataaggtgtttcaaactttgttatgaagtttagaagtagcccaacccacagaaagaaaggggtcaatatagacataaatagctcaaaaggccgggcgcggtggctcacgcctgtaatcctagcactatgggagactgaggtaggcagatcacgaggttaagagatcgagaccattctggccaatatggtgaaaccccatctctactaaaaatacaaaaattagccgggtgtgttggcgcatgcctgtcatcccagctacttgggaggctgatgcaggagaatcgcttgaacccgggaggcagaggttgcagtgagctgagattgcgccactgtactccaggctggcaacagagcaagactccatctcaaaaaaaaaaaaaaaaaaaaagaaaaagaaaaaaaagaaaaaagtcaagagagtatttacacataggtgactgagcatgaagagtgcactgggatcccagaaaagtctctgaatgtaggaatggataagattcctgcacagtagaccagggatgcctttttgttctctctctcaatctctttttctctctctctcagatgtacctgatttagaaaaagtattggacttaaaaaaaaaacaaacaatttctgagatccattccagccttacaattctatgcttccatgttttgtagtttctattgtttttattcatgaagagtttatgatcagttgatgccagaaagttgcaactcttgaatgactttaggaattcacctcattaaatggctctgtcacaaccctgagcttgcagggtcagggcccaagtgttccagggatagaaagctggcatttctgcttcagcaaagaggccaacatgcagcctctctgcttacttaacacctgacagaggggagagagagacacgaaacagaatacttgactgacactggcttaaggaatgatgatgtgtttgtgtcatctagtagatatttgccatttgtggctgctccatatcttccccatattttagttaaatctcatattacaagtcctccctgctcaaaaacaggagactagaaaactggtattttcagactccttcacagctagaccacaggcctgaacttgggttctatttttgccattgaaagtaatggcaaaaactgcagttacttttgcaccaacctatatcaatcgaatatacccatgtaagacttggattcatgagtgagcaatgtgagggggtggccatgtgtgggcactcactattctgagattcatcacggaagaggctgctacttcttccaaggagccaagcagagcttccagcattccagcacgtgcagaactggagctgagagcaatagctctgatggtaatgcttgcattgaaacagttcccatggcatggttggacattgttcttgtctctgtagttttaaagcttggctctctctggccctcatggagagtctgcaagtcccctaacatccttttaaattattgttttttaaaatttgaactagccacagtggaagctgtttgcagttcagattcctgactacagtggatgctgttgtttgcaattcagattcttgtcatgtgacaagaagtatggggcaggaataggtgatttcagggttgctgtggtggctcaaagtatcagtaaggattcagcctctatcttcccatgttttgtgagtttactttttatcttaaagttggttgtctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagaccaaccatgctttattacagggggcaaagacattcagattctactattaagaaagaagggagggaaggggttgctagataggcaactgatgcctaccaaaatcccactccaagcttgctccctcgttgacaagatctggcaatgggactccgctcctagaagagggagatttcctagaagattcccattcctgttttccccaggccaacttctaggtgcttcagggccttcagttgaacccattgtcagagagacctgggtttgaatctggctcttccacacccccagtgccacctgggcaagggtttcctcacttctctttcttcatctgtaatgtggggatagcaatagccctgcctcatggattgttgtgaagactgaatgctatagtaacactcaattcctgaacatgataagcaataactattttagaaggaggaggaggaggactagtgtggagtattctgatacatagtccttctagggagggtgactgacaacacatgtatataacccggtaattttagaatagaggtagttgataccatgtgtaaggtgagggtttcctcagacatgtgcttacaggtgtgttgcaaaacaatgttatgtgcatcagcttatttaatctcacataacacctttatacaggtgatgactcaaaggcttaaagatgctcatgatggatctgaaggaagaatctggtaagtgttgggcagaatcactcatccagttatacctgggctctttgcattcaacctcagtacctggaaactgaacaggaatgtcagtagcagattgcctgatgaccatcgaggatttatctggagaaaaaccaggagctttaaggtgattttctttaagtatcagcagcactggcttgtgaagcagcaatttcacatatatgtttagtctccagagattgaagataaggatcacattactggagataaattttgaacaacacaagaaaggacatggggtataagctacgcaacagtgaaatgagtggccttggggagaagtgagtttcctatcactggaggtaatcaagcagcacatcacctatagaggtgatccatgcttcaaatggaggcagggaagtatgggtggaggcttctgaggttcttttcagttctaagatccaaaattctatgagagctacaggcaggtcagcaccagccacacaggagtttctggaatggatggagaggcccttccagctgagaggggtgctgaatttaaagaggccctctggaaccaaacacaggtgtagattcctctgctcttcccttagtgcctctgctgggagaatgacgatgaagtcctccaggtatccaggcttctcccttgagcattagtgagagtagcttgttctgaaaggggagccggctggccattctcactgatggatctcaggaatgtcaccaccctggaggccaggataaaccaatgcatcctgtcctcttgtcaacattctttccctccaacatgacacagattaagagcttattttccaacagcctttgatgcatttttaaacatttaccctcaggattattcctcttgttctcccaacttctagccagctgattaaaattctagctcaattgaaatactctttcaaagtgggccattcagaattaagcaaaaagcactgaacttactagaggtctagcacttttgattaatctttaattaatacttcactttaattttcaatgctacctttaaaacacagagctgtgttcaaaccacaaactcattatcttatcattttgaaaggcaggactgtctgtcagagtataagaaaagggtactgtgtagtagtcttttcctggaagtcagttttgtaaaattttcattgatagacagtagttctgaaatatgtatatatatattagaaagcaaccatcttccaaaagatctaaagaatcagctgggagaaaattatggtaacacagggtaaaataatattgtgctgtgttgacataaattcatctttgttatttatcctgatgattttatctttttattggtgtatcacattgctgaaaatatggtttataatttaatttccactgccaagtacggagaagccactggaggcactgtaatgaggaaagaatagtcatggtacgaccatggaaaaggatgcgaagatgatttatgtaactttcttttcctatttacagtttattaagtcactgtctttttgcaatggccaagtgaaaattaaagcacttcagagaagaacttggggttcagcatcattaggggaagaggaatggatgccttgatgaacttgactatagaaatctatagagcacaacttaatcagccttcaaattgatcttggatgctcaaaagcaggtttaagactgaacaaatctttaatgcatatcctttccctttgaaaagcaacatatgatgcatgcatgagaatgatttagagatttttcccagacttcaattcataaagtaactgcatgtagcactttttgggatttcatgggaaaacaggaaaagaatggacactcttcatggacctgcctccttcctcagattctctgttcatgcccctgaaagacatcatctgtacaatggcaattacttagaagaaagggaagtcgcttgttgtccaaatgatcataataaaatcgagccactaatgttccactttctctttaactgcaggttcagagatgccagcagactccatgctcctgggctggcaaggagctgtgaggatcatgtagcacatgatctcccttccccatgaggagcagaagcttccacatgaggcaggtgacaaagtaataaggctttagtgtcacacaaatgtgactttgaacccatacttctccacttactgtgagtccttgagcacgttgttgaaattagttgagctccagattcctcaactgctaaaaggtgccaattaaacttactttatatggttgtcgagggaattaaagatactcattagtggggactagaggtaatggcaaccatcctagtgtcatgcaaaagcagactttattgggcaaatttatgggcagaggatcagtatgacaattctattcggtcctctgacagacaacggttcccaggagctgagttggccagatatagtgtgaggttgtgctctgggaatgggaccaacccttccctgctactctagctgtatataggaagaatatgagagaattctcaaaaaagcagcaaaagcaatctgaccttgtgccccggctgctcaatggtgttgtagataaacatcttgcaactggacatcagcttctcagggaggtatttattcctagactgatgtcagcccccatttgcaggtagtctaagcccctcccactggaagagttaagagttaaccacagagagcgatacatgctgggtacacaaggtggggcagatgctttcagcagcaggcagcaaggttggcattttagtagaggctatgccttggagtatacggttgagaagagagaccactttcccttgacccatatattttgtgagtcaagatttactttgtggcacttcagcggtggaactgtggcctgctgacaacacagctgtacttcttaaacatcccagctatctatggcttgccactgccattcagcaatcaggctttcctcctctgctacatggtgagttcagtataggcactgaaagcaaactagcagaaggcaaaatgaaattaggtttctaagaaaggcgttgttatctttcgattcaacaaaataaacattcacattgtacctccttggtgccaagaaatggagcaatgggagggggtttaataccagcaacaataattcctaacagttattgagtttgtctgcctccaggcagtgctctaagtactttatgtgttttataaaaaaataacatataacacctgcctttgatttaagtgggaagtcagctacttaaccaacctaataggcagtgctagtgctcagtgccataagagtgtaatagacaaaatgctactgcagcagagaagggttgcaaggaaggtcagagaagatgacatttgagctagaagggtaagaattagccacatagaagaggaatggaaggaagaacatgaataaaggcatgagatggaataaagccatgataatggtgttgatgatgatggtgattaagacccaagggcaaggagaggaaagagaaggaggaacagaaaaaaaaattaaataggatgtaacagatttatactctcagccatcatcaatatacctgtcagtgcaggtttatgtttccatacacacttttcattcatggactgggaagggactgagaagcaaacacaaataggactacaacagtctttgttgacttggccaaaaagcaaggcatcctgtctataggctaaaggttggttctccatttctcactgccattttaggtaaacacactcttaagaaaaactgtcattactcctcttgtgatctttcttccaaagaccccatgaatcctttgtaaatttggtgaggtgctctatgtaaaagcactttgagaaaggtagcaggacccaacgtggaggcaaaggcagtctggtaaagaagtcaggtttctcctttgcagtgagctcacaggatggaggcagccatggccaagctgtctaagggcagaggtaccacagcacaggcacggggcacttgggtaacccaggtctttcccccactcgcctgtggggagcccccacccttccccaccaggtagtaaaggctctgagagaagaaaaagacatgggttcatgcattcgcaaatgcttaacatttgtgaagtgccgaggccaagtgatttggacacctttgttaaggatctctcagtgtatgaggaaaagagacttgtaaaaaaataaccgcatataacatgttgaatgttataaaactgtgatggcacaaaggagggaggcaattgatggggaggggtttgatagggagggtgtgggtacagtaaatactccccaaagaggaatatacttgagtataagagagagaaaggagcttgttatgcgttttaattcttagtgtatatacttacctctttccattggaaggttttacttggcagggcataaggagtaatgaaggagggaaagggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttgggaaggtcagtgaaaagattgaggttagtgctatgtaagctccaagccttcaggaagatcctccaaggaagagatcctgaaggcaaaactgagttagcgggcctttgcacagctttcctttgcaagtccggtgtccagaaaatatgaacctcctcttttagcattatcctggtacctgttataaaagtaggaccttcttctaccaattacagtggggatgacgtgagggctgacatttctgaaggtctaccttttggcaaattagatggatggattaagtacataaaatttcatgtgattctcatgaccacattacgatattgggtatgaaaggctagacccatttcactgatgtctggaaattatggcttagagttacgaaataattatctgaaatgacattggtggtacaagtcaggattggaaaccaggcctcctttattccaaagcatttgtctttcccactatgcaatgtttccctgaaagcattagctggaaccactgcttcatcagagagtgccttttgtttgtgcatgatcaaatgtgaaaatgtaaaatattttatatatgccaagtatacctatatgagggattattatagttatttgtcattatttcagtgctactgaaagctttccattatttttaacttttaaattttatttttgagtcaggtccatgggaggctagatatttggagtttcaaatcagttaattacctaataaaaatgcaatataacatctgctcttcaagttaacatttctcctggtcaagggcaaatttggatgatgaaagcatttgtacattctcagactctgaaatccttacagtgatatttatcaccactgatttaaaaattggagggcaagtgtcttgaagccttttatctttccaacgtgtaattaattaccttgtttaaaactcttatgaagtaggtggtgcaggtattatgatcctcatcttacattcttccactaattcattcattttacaaatatacattaacagatttaaaaaatctaagccccagggagatagctgatttacctctaagtcaacagaagaagcaaatgacagactgaaatcaagattcctggctctgcgttctgaatttagggcatttctactaaaccatcttgcctgagtctcagcattaacctatgtcttttgtatatctatccttgatatcttaatgttctggcatatttcatatttctattgtagaaaagatcctgatggaaccagtagcttctaaatcaacacacatttgcctccaaccccccacctccatgaaaatgtggttcttaggactgctgtagcttcagcaatcctgagaaataaatgtatgaagtggcttgtgcactaactcaactacaggggatgggactgctttaattgccatgaggcgctgaatgcagttaacactcagaggaaaagagccttgtttcttggtttctttgaagactgacaattattttatggaacgacttcatgcattatcaaaacttccatagaaattcaatgagacactgcatagtaaagcaagagcccttcccctttacatagcaaatatctctatatacataccctgtacttctcaaacacaaagaagatcgttggaaaacacacagttatgctcaagggagcctgcagattagttctccagcacctcccatgaccctgctcctgcccttctcatctccacttctcctatcaaagattgaatcactcctactcatctaccatcattgtgccctttatagactctatgaataataaagctattttgttttcattttttattttctttcctacaaaatcgtgtgcttaccaccaaagtcagagattgattttgttttattttcatttgtagtcttgatgtctaacacagtacctagcacaaggcaggcactacacaaaatgtttgctggaagagacacaaatgcataaaatcatggtttccatccttagtcaattgcatgttcattgttaagcaaaagaagcaacaggctttgaacatatccagtgcttccctaccatgtgcagaatgttgtgattaagaaggcactaccttggccgggcacggtggctcatgcctgtaatcccagcactttgggagtccaaggtgggcggatcacgaggtcaggagatcgagaccttcctggctaacacggtgaaaccccgtctctacttaaaatacaaaaaaattagccgggcgtggtggcatgagcctgtagtcccagctgctggggaggctgaggcaggagaatggcatgaacctgggaggcggagcttgcagtgagcccagatcgcaccactgcactccagcctgggtgacagagcaacagagcaagactccttctcaaaaaaaaaaaaaaaaaaaaaaaaaaaaaggaactactttgtagaagaggcagttaaaaacagaaatgaagtaaaaaattcattgattgattcctcagatattaggtaagtactcattctgctccaggtatgaactgataactagacatataaagtaatgacaggggaccctggaggggcttatagcttggtagagagattggcctataatcgactaactaaaataaaccaaaatcctaaatggaaagaagactgaaatataaaattagaaaactttggaagagatgcaaatatagctctggcagaggaatccacatgaaaatcaattccaggaatcagcaacacactgctagtcaatgagcaatgggtctctaacatttagataaagtgttactcggtgtcagacattgttgcaagtttcttccttctattgtatcatttattccttacacttacgctagaaagtaaatactcaactccttttacagataaaaactcgggctcatgtgcataaagtaaatagagtatagtgtttaagtatacctgttttggagtctagcataactagatttgaatattgggtccataacttaactgtgtgaccttgaactaatcatgttacgcctcaggattttcacctgggaaagtggataatgatagtgcccacctcactggtgaggcaggtgaagtatttaatacggaccccactaagtgctatttctttagtttgagagcacactgctagcaaggatcaagatagggtttcacactcaggctttaccacagagctcatgctgtttttactgagtttgttgcctttctgggcaaactggataattgacatgcattcattagatatctgatgtggacaaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctggagagtaggtcttagcttgaggatgggaaggatgatgatttcagttttgaatatattgagtctgagattcccatggatcatacaagtacagaggaaagtacaaatggagaagctatcatctctaggaaactgactatgagcggaaggccaagaagttttgagtatgaaaatacgatatcaaaaccacagtgaaaaaaagtgtggctgtggctacagatatcttaaacaaaacagaccagcattgaaaccaaagcagtaacagaggcagacttcagggagaacaaactcacagtttatcatttaagaaacagaaagcaaaccagagctgagtccctttcatgagacccatgtgcttgctcagaagcagagctgaagtaatattctggaaggctaagtgatgggagtagggagagatggtaacggccttcagttttatcaaccaggtaatcaggatcctgctttcctggagagaaccagtttcttatatgccaagtcccttttgtttacccataagaaagactagctcttttggttccttccattccctttcctacagcagtatgtccagacctcaccctcccacaccacccttaagccttcattcatagttgccatcttcagtccgcatgtcattcacagttgccatcttatgtgactgtgtgtagatacatactgatagttaattttcatagtcccctttcctggtttcatggcctccacacacagctatgacactagtattgtctctaactctggcagcatcttccccagtaaaccagtgtgcaaaagagtgcatcttctttgctagtgacattttactgactggtgctcatggcagtgtttctggtgcacatctggctcctccacaggggaatttccaaggtaagtgtgggaagacaaacctgcaaataaactccaataaataggataaatagcaggatgtatgtacaaggtttcaagagaaattggactagagttcatttcacttcaaagaaaccttggttagtcttcaaaatcaccaagtaaacatgggcagaaactccctccaagcaaagcacacagtatgggttgatttattattttggctactttttcaaaccgctttggcaaaaagagcagaaaacctggacttaaccagcttaaatttatgatttattgtctcccagagcaaggtgtccacaggtcaggaaagctccagggagggtatattaggaccctgactccacttcactgtgaccctgtcttcctttccaagttttgcttcatcagcagttccatgcatcatatccaggcatgccaatgacaagaggaagagaaggggctgtcttttccttctgcctctttttaagaccaaggaactatttcccataaatgctctgacactttctcatttcactggtctgaacaaggtctgtgtgcatagctctaaacccagtcacttataagcagtatgggattcctgtgatagtctgagactatttggaatttgtcccccaagagggatagggtcatgttttctgagagggcctacctgaacaaaatcagtacttcatcaatgaagaagagaaggtcagattttaagtatatagccaacagggtcagctacagttactatctacatataacacttattttttttaaagagaaaaaacaaaaacaatcacaaaggatgctgttagaataggatcaggctcaagaagatacactgattctgggacaaggaactctgcttatggatggcgtgacacaattatagagaaaatctgaagatctaaagaactggctgcctgtgagcaacagctgcagaaatgtaaaaatatatcctgtttatccattaaacactaccgagattgagttgagcactgcaccatgtcagataactctgtgttcactatcagaatgtgtgcagttttagagtgagcagtcattatatgttacatcatgcgcagttttgaaaagtcacggtcactaggtttacttgttggaaacatatccttgtaaaagataaggcatcgttggcatgaaactctctttcacatatacacttacacagagaaatatgtataactgatcatttatttttctttcatattaaaccttttttttttgcttttagtaagagtcatatcaatgaaaatggcaacatttagtctgagaaagttaacagtatatggtatggaacaacacaacctgaccccatatcttcagctggctttcagttttcataaatgaacttctgagagacaactaaaaattcatttctggtgcagaaaaatgtgcagaatgggaactatgcagaatgggttaattccagaagttgaacaaggggaatgcacatatgcaggcttattaagttatgtgcaaatgataagtacagtgaccatctccattgctaaaaattcattgtgaatgtgttgaagttgggattgatggagatactgaagtgatagccaaaattcacccagaaacaagctaaagtgaaggttaaagaaaaacagctgcagaagaaacaaactgtggagacatctccagcagtggaagcaatctgtttttgaagacagcgaggaactccaggcatctagcacattctgaatgggtaaagtcggactggagtgggttgctgtgggaaggagccattctctaaagaaaggtagacagcttctcacggctgggcctctaatgttaggctcagaaaacttactaagttgacaactctctaattacacagcctttgaataaaccgtgacatttataagaaaagacatcctgtcatttatttttgttacactggtttttgccttgcacactggtttaagacttcatgggacttttgaagaacaaattttagacctctgctacagggcaggttaaaatggaatcatccagttgctggttgattttttttcccccacgtgaagtctcccttggaatcaaggtaccagatcttctcttggttatctgaaatgatgtgtgctcatcttcagtgaagaagttcatgactcaaatagatcctagtaatagtgtctaattatatatgccaacctttccctacagcaatatacttcccttcaaagtaattctaatattattactttttttggtattgcattaaagaagatagaaagattttaatgctatctttaggaggatagaagcgtagctgtagaaagaagagaaaaattcagggagttcttattacctggttttcatgattagagtctccacagttgcaaagttttacagaaaagtaaattcacaatagcatgaaaatagtcatcactgaattgaccccttaaaaaatcagtccccattcaaaatcagtctcgacttaccactggaatcttagtcaacatcataactgatctctcaccaatttttataaaatagtcttataaaaatgctctgtaaattgattataaggtaaatttttaaatttcccccagaaatgggagattcatgaagtttaaaaaagtgatgttgaagaactgctggaatcacacgcagaattattgatatgatgatgtgacagaaacattactagatcttatttgaagaagaggaaatttttaaggataatgatagtttaggcttccagaagagaatgccatgaatcccaatagaattagggaatattgataaaatacttgaaatttgtaaaataaccctttttgtgatgttgagaaagtcaaaattaagtaaagaatatgttgtgaaatcatgtaatttttattagaaaaattgtaacaaaagttgaaacatgacaatttatccttcaagaattagtgaatagttatatttattacctgaaatatttttcaaatttaagtaaaatatactaatttttaaataaattttcaatgtaaaatccaagtcaaaatattttcactcatctttaaatgaattttggttttcattttaagataactcacttaaaatagcgttttctaggtatccattgtcattaaataacatggaatgtctgtaaatattcttatctcttttcactgagccatacaacctcacatgagactagaaagtcccagcataacaggtttctggaatggaagtgtaacactgtgcttgaggtagtttcaaaatatgtccacaaaagaggcagagcctaattcccctcttcttgagtgtggcctggacttacgacttagtgctaattaataaaacaaaacagaaatgatggtgggtagagtggattgcatagaaacacccacacccaccgcacaaatttgatgtccatcagaacctcagaatgtgaccttattaagaaatagggtctttgcagatataattagttaagatgaggtcattatggctggccctaatccaatgactggtgctctcagacaaagagatacaccgacagaagacagccatgtgaagatggaggcagatattggaatgatgcatttacaagccaaggaatgccaaggattgatggtggccaccaggaatgaggaagatgcaaggaaggattcctcccctagaaccttcagagggagcacagctctgctgacatcttgattttgaatgtttcacctccagatgtgacagggaatacttttttattgttttaagccaccagtttgtgtcactttgctatggcagccctagaacatcagcacaggagatcacttcaaagactgtgatataaaggcactgcggctttctctgtgctcactctctcttggatctctcactccagtggaagttggctgtcaagtcgtgaagatattctagcagcctgcagagaggccccatggtgaggaactgagccttctgccatggccatgtgagtgagccatcttgaaagtagaccttacttttgtggaaccttgagccagaaccccagtgaagctgcttccaaattcctgatccacagaaactgtgtgaaactaaatattgttttaaaccactgagcattgacgtaatttttatgcatcaataaacaactagtacagtcccctttgttccctcagatccaatttccccaactcaaaagtatactcaaaatgcactcagcattgaacagatccttcttctcctaaggctctgataactttttataactttatttccactccttgtccacctcttttcctgacaggataaaaagtgggcttctttcttgcacagaacgctctgtcatataggcccatcatctctgatatgtgaagattctaaataaagggcgactggcttctgtgaatgagttttattagttttattaccttagatatttcaaacgtgatctgaagtttctcatattcccttgagaaatgctcatggacatgaatgctaacattggcattctacccagtaagctttagaggacattcaagggaattcacatatctatgtgaacagctggtctctggtctccctgatccctcgagagcccagtgagggcagcttgctgctttaacaatttttccagtgaggaagggagaggatacctcaccatggagcagagaaaatggaagcacttacagacataccacaggtctgcaaaggaggcattggccttttgcctgattttacccaaacttatcaagtgcctgccatgcactgggcacaataagttaaaggcccatcattatcaatcaggaaccaccttccaggtgacaactgcatccatccaatgttgaagaaggaaaggtcagagcaggagaggagaagcaaatccatttatacagcagcctcagaactgcaggatcacaccccttgggtgaatagacaagctctgatgactgtctgagtgtggaaaccctgagctggggctgcctatggtcagaaatgccagccaatcttatgtgccccttgttgcacaatgatctaagtgctttacaggtattagccctggaaatcctcataacaatcttaacaggtagcaactgttattatcctcatttcacaagtgaagacactgaggcatagtaagaggcaaagctgagtttaaagctgggcagtctggcttcaggccatgcccctccatattaatctctccatagtcttttgaatgccagcaaaaaggatgttttactctttactacatctgatttggaattttgataaaaatgacatgaggcagaatttcaagccttttaagcaaatcatgcaagtctaatgctgtcgcgcttgctctaccgctgtgggctgatttgtgtctgtgctgggtagatatgttttagaaaagtacatgatgggaggcaggctcagctgttttgcgatcatgccctaaaatggttaggaagccagtggctgacagggatcaatgtagcactgtgaacaagtctaaataaatgttaatgtaatattttgggatgaaattaattaggtgtgctgatagttgcctgatgaggtaggcagatcagtatgatgtggaataatatggacagtttagtgttatataataaacccaaaaccatcctatgacgccctggatgacagctagggaatctctggagctcaacatagattttctttaaatagaggctggtaactaaaagagattctgagtctcacatcagctgcactgcatcagccctctttccttaatctgtggttccaaataattttgtaagtagataaaattctgaacccacccaataataatataaccagacaactaatactgcaatcttccctcttgcagggaaatcgctccagaaggcaaatgaagtagtctcctttttaagcatcctctgcttttctgttaaagtttgtctcattgcaggaatcacagcagcttttgacagcctgggggtggtgaatggacttctggatatttggagaatgccaaaatcctgttatgtctgttattgcagtgtacccttgagtacagtctccccaacttttttcaatatcatggtcacttgggatatgataataacgcatatcatctaattccaaaatgcacttctttgcatgataaaatctcttaagttgggatatatcttacaattgtgagcaccttacaattgctgtcatcttggcagcaggaacatggtacataaaatcatcctgcttcttataatggcaggaatcagtgggatatggtatttgtgcagcatgctggggtaaatgcattaggcttcatctggttggaggcagccttccatgggtctctgtaaccaaagcttctagacagcaccccttggggactgagaagctcaatctctcaggtgcctctgtgattcatctgtaacaactcaggagtgtgtcctgagacttgtctcctcaagtctgagccaccctatctgtgaaacagagatcagaacagcactttccagacgagaccttttggggaccttctgcaactttatgtgcacaaagtacctttcatataatctgacatcaaggaatttcagttactgctattggctttacagagccagggctaggttaaggcaattgaggcattcaccttgggcacaaaatttaagaggtgccaaaatctcagtgattgagataagtaatattttcatgcaatatttttaaaagccaaaatcaatgcaagaaaggatgaaaaaataaaaattttaaacagagacaggatccagctcttcatttggttgatgcatctcattgacttatcctggtcttagtccattcagattctgtcttgaatacttcaaatattgcattaaaatgctatttatcttgattactaagtttttttggtgtccccttaaattttgcacctgaggcttgtgcctcactcctctcacactcatgactctggtgatatttctgatgcatctgatgattgtttctaattgtgcctaaattggtctgatattaactatctgttgactcatatactcattcagcaagcctccaatctgttccaggtgctgtggcaggcaatggagatacacagcactggcctgtggagaatgcacataagcaaacaaacatgtgccatatattctttagggctgtcgtgaatgcatctattcattgattcactccaaaatgttcagcaagcacctcctctgagtgtgcccaatatgagcctgggacaactggagtcacaggaagaaaatagtcactatgtgagtcagtgtttccttacaaaacatttatagtggccggaggcagtcgtgagaaatccttttgaaactaaaaaattgctgtgggcagggcatggtggctcatgcctgcaatcccagtactttgggagggcaaggcaggagaatcacttgagtccaggagttcttgaccagccagggcaaaatcgcgagaccctgtttctaaaataataatacaaatagctagacatggtggtgcatgcctgtggtctcagctactcaggacactgaagcagggggacttcttgagcccaggaggccgaggatgcagtgagctgtgtttgtaccactgcattccagcctgggtgacagaatgagactgactgactgtctatctctgtctctctttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatataaaactaagttttttggagtccttttaaatatatgtagttgtagctagctcacatgcatcacctaccacagtgcctagcacataagatacacttaataaaatgtttgttgaatgaccattcaaataaatggcttcctataagtaagatggagatgacaaggttacactatgcccacctagaacccctttgagtgccttggatgctggagggcttggtgcaacggaaagatctgtgatcagtagatctgaacttgaaacctggcttcaccattcattagctgtgacgaccttggtcaatgtatttaatctttctgcaactatttcctttaataaggtcaatactaccaaatgtgcaggtctttagtgagattatagatctgcaaagtgcttcataaagagtctgcctcatagaagaaacttggtggatgtgcatttctttcttttctattttgtttcagaacttgatggaaggaagtacaggtcagaaaggctgagttaaccccaggcaaaaaccactcgggaaatgggcaatgagatatcacagccgctgtcatgccgagggctgtgaccacaccaagaatgagaccactctctttctttgcatgaataccccataagcaagttgaatatgggatgtgaataattcaagtccatttccacaagacagtcacagaaggattggcttcttcaggaaagatgccaaactggggtctttagaactagcttcccgaagacatgcttcaaggacagggaaatacacatgctgtaagcagggaagtcctgaatgctatggcagagatgcaaattggggctgtgtcatgaaaacaaaagttaaaccataaaatgtcactttacatgcagtttaagagagatctatgagaaataaactttagcaaactgctcacatatatcagtgtattacaggtgcctggaaaagcatttctatgaaaatatgcagcatggcatatgtataaatctgtcctgagttttatggtttcatatacagaatcataatgtatataaagtagaggaacacggagatccagtttactgctttaacccatgctagtcaaatggtcttggaataatccaccgaacttacaaagcagcaaacaagtacactcgccacctagaggaaagccagcagcaaaggcaggtctgtctgcaagcattttgtagagtggcaagtgggtggagaacagaatgagatttcttgaccacttgcaaggggtgaggtctctgtaataggtgaggtctctgctaagcacattacattcattctctcacttcagcctccccataactttatgaggcaggtactactgtctccatttcacggatgggaggaccgacaggcaagcgtttgagttacatgtggaagggcacataggcagcagatattgcactgaaatagaagcctcatgaaagcaagggccttgcacaccactgtatcctcagctcttagaacagcgcccaacacttagtaagttcttggtgcatgtgttgagcaagtgagtgaagttggcaaacctggattcagctgactttttgtctggtttcttcccatagaatctttgcagtgatgacaggaatgaagcagcttatttgtgcagaagagtgaattcatgggagtgcagggacagctgcagcctctgagagggcaggttatggagatcctttgggaattcacagtttaaagggcaagctgccccttcttcccagtgcctgccctgaccatttctgcagaccgcgctgccatactaaattatccctgtgctcacatagtagcttctgaggagcaaagctgcctagcatggagtctagaaagaccaagatgcatgggggtggcagacccagttccaagcctcagcactgtcacttattagctatgtgactttggaggtatcacctaaccctatgaaatgagtacattaatgcccatcttaatatcttctaggctggacaagcttcataggctagatagtactcaactccacagcctgtaacctacgatgcaaacggtggcccctgaagttgttcaacacagcggccctgctcctggatgaggacatgggtacagaggagaaagaaggcacaaacagagccagccaaacctgcattcaaacctcagctctgccattctcaagctgtgccatcttgcctcagtttcctcacccataagtgggaataaaagaaatatgtacctcacgggttgttttgaggatgaaattaattaatacatgtaaagcatttggaaggcatgtagcaggtgaatgagaaatattttattgttattttaaatttatgatataattttactatttttaaaattctgtattgaagcaacttattttagggtcttttcctgaacagatttgaagcttctggaagtcaagggttgtatccacttatccacatatcaccctttgtctagtgatgggcaaatacatggtccttgataaatatttgttgaactaatctgaaccatctgttgtcagataaaatccctagtctctttggccatgtttcctcatgaattactttctcctgcttcaaacattgggaaatttgagccaaacacttaacttgttttagttaaaaggtttagatttcactgaacttcagattttgctaaactttccttccccacttttagttccatcttaaatcctcatattttgaaagaaattaggaaaagctctctatgtggctgttagccagaagtccacacataataaagacttctagttgaaagggcttaaaaaaaatctgctgctcttctcctttgggtcatacaattaagtagaagaaatacaaaggcaacaccttccacccaggacccagccagcatcatgcagcctttaaaccttccagggccagtgttagaatcagggcagaagcacccggtttgtcacttgcaacattcatttgtttgcaagacagtatcagggtggatggacactcagtcatgaccacagcccagttccgttcaaagagatttcagctgcaccgagtcagaggcgaggagattgggcttgtctgtgttctccacactataatgataagtggaggtgatcaattgccagagaaactgcagacaaaaaagcccccattaattttctgaaatatttaggaatttgggtaataattcttgagtagttaatatgtgtcacatatagtactattatagtactactaggcacttgcttatatgttaaatttagtcatcatggcagttaaggtaggcatgatgaaccttcagattacagactcagagaggtaaagtaattttcccaaagtcacacagctgaaatttaaatccaggtctgaatctaaatgtcctatgctgagttaaacacttgggctgtggaatcagaaggatctagatgtaaattctaggtctgcctcttaagagctgtattgtttggaggaacctattaaactttaccaatatcatttctaccacatggtaaaatgagaataagaactccactcacagtgttgttgtcaaggttaagtaacatttggcacctgagtctctcagcacaatgtttgccacaaagtaaacaattaatcatgttcagattacttattactactttttaaatttactactcctacatcatgctacttacataattcagatctctcccattctcttaattcttaagagaaaaatggctttagaaatgtttaatttagaaaccctaatttgtctaagctgttttatttaaatgaaaatgcattctatttagaaataggggggctttatcatatgtccttggaaaaactgaaaggagacaagcggatagctaaatagagcttgagtccactgagagacattaaactgaatgctaatatattattatatatttgctaataaattatatttgttgtttaataaaagagagaatatttttaaagtcccaatgatgatatttaactgcataataaaccccacagaaactgctaatcaggagtggggtgattaaatactgcagtgatctaatgctgaaagccttggcattgccacccggtgtccctgatcctcaggctgttctgcataaggctggacaagggctggtctgtggggcatggcctggagcttgtctgctgtccctgtgctggtcaggggccttgctccatgtgcagggagttctgggtaattagaatgtctgtcccagtgattcctttaagcagatatggcctgcccatattgggaatgccccaaaccccaacagaggcacttgcccatgatgttggacttagcccaggtcacctcttggtgcatttactccaatctgtgcttctttctgctcttggttcctcagttcttcagactcgttagctctttctgtccactgtaggatgccctggtgatatggcttggctctgtgtccccacccaaatctcatctcaaattgtaatctccacgtgtcgcgggagggaggtgaatggatcatgggggcggtttcccccatgctgttcttgtaatagtgagttctcatgagatctgatggttttataagtgtttgactgttcctccttcacatgcttgctcttctgctgccttgcgaagaaggtgtctgcttccccttctgccatgattgtaagtttcctaaggcctccccagccatgtggaactgtgagtcaattaaacctctttcctttataaattacccagtctcagggaagttttttatagcagtgtgaaaacgaatgaatacatctggccttggtgacctgttatacaggcatgctttatgactcagtctctgcacctgctctcagatacacttcagatgtttaccttctggtcctacacttggccacggatgagaggcaccttcatctcgccaagattctcagggaatgatcagccagttggcttgctctacggttttctttctccaccttcctcacgagattactctggccaatgagtggtccctggtgagaaactgaggccaagtcaataggttcacagggcaggggtggcagcagcttcacccctgctggacattgttaatgttcagtgaggtcaggcagtctttggtcatacaggagacctaggattaggtctaggcattgggaagcaatggcagagttgtggctgggaaatatttctccagggaagagtgaaatgcatgtccatgcaatttgtaagttaacagcaggcactcaatctcttgactctattactagtggcatgagtagttttcagggactagttttgtgggtagctcccctttagtctgggaacttggatgaagagatgagatggccgaggagtcacttcctaatgaaagcagcatctgaggaaggtgagttctgcacaagtcatcatgccaggactgtggagggtccctggaaggcagaggcatcaagtcttggttcccctttctctctcctagaagagggtatatggtacaaggcactctaaaggcttctggccacgtggcttatgacctaacagaaggaactggagcatattcaaagcttactgtggtgtccacaggggattaagcaaaccagggaataatgtgatcattcatctttccttagcatttggtgtgtgttgggtctgggtcccagtgctttatccagctcagctcgcttaaacctcgcaactaccttatgctctttttaccccaatttcacagaggagaaaatggaggcacagggagattgagtaactggctccaggtaactccagagtcagtgctctgatgctgcccctcttaccatccatttggttctggggaaggttgagtgcaaaacctgataggaagagaggtggaaagagcaccagttttggatttaaatcaccccgggtgtgcctatggctctgtgtctttctgctttgttacactggcaaaattactttactttggttttcttatctataaaatggaggataacgccagcttgaagagttatgaggaagaggtaaaatagttactgtctcccaccaagcccacagtgcctggtccacaatgagcatttgatatatgttggttcttattactatacagaaaagcactttgtaaaatgtgaactataatagacctttaaaactcacaatagcaagattgtaatatgcaccatccttttaagaaataaagttgagaattaaactatcacacaccattgactataagacccatctcaacttcaatgatgctaaatgcaaaatatagtatagtcgacctaggtgcaaaaaactcaaaaagcatttgagatccccttccaccctaactccagcaagaaaggaaagaaatgcaaagaaacaaagacagaaccagtttcttgaggagcacagtgcctgaaccataaagaaaatgaaaagctacacacagatgttcatccaggccagctttctgctggtaggtaatgcatgaaggcaattaggtgctggctcgtctcttcaacattcatggagctgcagagtttaataacgttgaaatctggtgctacctcaaagtaaaaagaggtaatgatgaaagttgcaattaattccttaaatgaattcttaaaatgtcaaaatttgaactacacaagtaatcagtgtacagaaagtggccacaaggtatagaggaggaaagagtgggggacttggagcctgaagacttttgtcatggtctttgctttcctccctaattgccaacaggatctgaactggctgattcacctttggactcaattaccttatctgtcaatggggggctgaaggagcaaacagtaaggctctttcagctctgagcaggcatgcacctgtgccccgcgcaaatgtgcaagccttaagctgaagagggtattaggaaagtgaactttctaatgtttctagcattcccgacctgtcccctggacaatcctgtctctttgctgccagtgctttctatttgcagaaggactgacatgcttgattaaaatgtctcaagcatatccaatcctaatgtattagatctttctttcctcccatgcaatagcagtggcagaaactctgcattgcaaactcatagtttgtttcccgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacaccaaacttctgcacaaaccagcgtttacttatttatttggtccacaacgaggaggaatacagagctgaatatgccacaattcccatttccagttgattctcacattctcatggggcagaaagacagcttcaagatccctttactacaagctgcttgtgcagagtcctaggatggaggtatgatgaaaggttatctggaggtctgaggaaccccaagttgaatcagggggcttatgaaaggctccaaagcgggggaggtcagatggggctcaacaggctgataaaatggttctacatgtagagaaagaaggaattggtattctaaatgactgacataacataaagtccatggttcaggataatagtccagagtgaacggtggctgaattatggattttacagatgtctgtgtgtacatgtgttacaggagacaaacagggaggttgatcttatcttatatgcagtgcagagcaattcatttgttttgaggaggaaagtgataccacaattacataaatcaaggatttaaaacattatcatcatccaaacaaatggaaaccattgttttttatttaccaaagcatatattccatgataatatttagtgccatttacaaagtatctaacatctccaggcattttacaattgtgatgtccttgccaaaaccctcctaaatatgtattattatcccgttttacagatgaggacactgaggttctgagaagtgacataatctgcatatcatggcagagcgaagactagagaaaaggctatccgattcaaaaggctgctttactcccacctgcagtatacgcctaccaccacatgctactgattttggcagccaagagcatgactctgtattttaacaggaaaagccagagatgaaaagtactgtcattagcatagctcctcaaggttactcttaggaatcctaagcaccataccatgcagcactatacaaaaatctggttcagataatgatgctggcccaatttatctgtcatgatacggctgagacacacacggcttcatgcatcaacttactatcgcaacaaactattagcaaaaaactattattgggtttggggaaagagcagcagtcctaatgttctattcccacagccattctcataggaaagggttggaaatagaacagagtctatctttacgatctgaatgacataagagacagtggatgacacaagcacaatattctgctttcataattttatgatttcctgtctagtctgcaggaacaagtaaaacaacaacctctctggttctgtgatagcatctgtccttagaaaacactcatttttagcacagtcagggttgaaattggatgagaaattcaggggtttctccttagcctcagttgttcaatcttcagaggcccactgtctgaaattcaggggaaaaggggctcagtcaacttcatattaactttttcttaatatttataactgtgacatgcaactataactatattattatgtaaattgagaaacggaaaggagagaaatgactcattatatatctctctgggaacttccatcaaaaatgtaaatcatgtaagtttcagaattctaggtgggcacctggaatcttccacttgtagttttctttggagaagattaaaaataaagaaaaccatatgttccactttagtgagcaagagtgaagggacatcggtattaaaagcagaagcaaaataggcagatgagagcttcattttatactgagaaggcatgggtgcaatttacctgcaggccattttcactgggacaacgaggaaaatgtgcccgtgcagagacaaggagtccccacagtctaccccttccaccaattttcagtgttttcctgaacagatttcaagcaacaaaacagtcagctgctgggtaatagctccggttacagctgaaaatgttagtcatttcattatacacactccaaaaggggtatataaaagttgtttacaagggcaaagccgtagttctgaaagctggctttaagagctccttctaccttgccatattttaattctttgaacgtgcaccaacaattacatttttataactgctagcacaggaagttattaaaacacttggctcctatgtgtcttggtccttgcctctgctggaacattgtaaattgttatggctagcacatttgtgcaaacctactgagagaaacatcatatggaaataatttcagtggctagtgaagggtagttaaggacaaccttaacatctaggccatatgatgcagtgattaagaggaaaggtgctagagtcagagggactaagcttgaatcctagatctgcctattaatccctatgggagcaggtcacttagcctatcaaagtctcggtgttcccatttgcaaaatgggaacaataagggtacctccctatataggatgtggtgggaattaaatgagatatacaaagcatctagtaagtgcccaatgttagttaattattaattaattgttagttaataattaacataagctagttaattataattagttaataattaacattaaatgttagttaattgttggggtgatatctttttctcttctacatcagggcagagttcttcaatctgtggcagaatgaaatttcatgaccaaatccatacaagaaagtgttgtaatcactttcttaagagtactgaaagtgaacaatgacaaaactctaccttgtgcctccttcaacaaggggtttcagcccacagcaagattgacactgctgcctggccatgtctgtaagtgagtgacagcaggtaaacaattgtcagcatcccaaactagtatgttaatgtctccccagtggccacgtttgttatcctgttccctcatattggaattacttggctcaggagatctgccaataatatacttttggctgggttttgaaatcaccttgggatacccagtcacacagtgaggctttgtggtacatggttctctgtgccacgtttcacacaggccactgaagggctgtcaatattggcatcaggagagctgagttcaagtcctggatctacctcctattgatgatgtgattttgggcacattatatgaactctgagcctctgtttcctcatataaaaaatgaagaatggggataatattatttatttcacagggtttttgtgaagactaaaagacgtgatgcaaaagggcattgtaaagtataaagagccacatagatgttattataacttttggtaaacaggatcatcattgttggatcagttgcttatattaagaattctgagggtttctgtggctgaagattgccatgatacacataagaataaatgttatatttcttatttaaaggtcagagtggtgagattggataaggataaggtacaatggtgagaggtgagtggctgtttgtacagggctgtgccaggctacagggatgcagaaaaagaagtgtgcaaagacagagcaagatttacttattcctgatttattagaactgaatttctttacatttttcttccttccttacaggcatatcccatttcatccttatgttctttccaaatctcattcctggaaaccctttctcccctagtctcttgagacactttggacttagcactcatgaagcattaatttttaaatggcatatgcttttacaggatccagtgctgaccccatgaaattagccctccctatttagaaccacccaattatgtagagactcaagcacaatgagatctgcaattctctttgcctcataagtcttaaggctttattttcagcattgtcttgttttctttctccaaaacatccaggaaactgaatggctggaagtctgactgcaaaacaatggttaggatagtggccaaatatgtgatgtttctgaatatggaggaggtgggcctgacattccatgctgcagatatgcaagaataactggaggaaagaaccaactggtggggcatagttggcccctgtccacattcacttttcctagacagtcttggaggatggatgctttttccttaagttaggttttctcctccccttaggcttttacctatataacagaaacagacttctaatgatatatttatatatgccagtaacatataatatatagagatgatatagctgtgtattaatagttgctctgctatgtgtctataataaacactacatagcagttattgatttatctctcccactaaaatacctttaggggtattcagaatagacgcccctccagcagccatcttgatacactaagatttggggaagcaaacaaaaatagactgagaatgggacaaagatattacactaagtatttgacttaatcctactccccacaacctgtgggctgtattgcgctgacctcctatgaagccaaggacagaaactgtactctctgaaatcttaacataaaataccttccatgccatttatgaagccactgtccctcagcttcaaatctaactttctgtactttgctttgaggtgctgggactaaggactagcaacctgcgtttctgctttgccagctgatccttgttaggttctgccagtagggggtgctaaaggagactgcgaggccagaggacacgggagagatctgatactcctagtagtgtcagcttagtgtttgcttcaagcaaagtgttgctggcctcgctttttcattctggcagcagcagttcctccctctaacagaaatctaattcagtttgcagtttctccaacgttgcagaaccagcctcattgtggagattttctaaatgcatgagttaaaatggcaaaagtggaaaaataaggatgagagagagagagaaaaaagatgtacatacagcaagtataggattagaaaggcattaggaaaagctttacctgtgaaaaacccctttccccctattatattttaaacctgctgagtttgataaaatgagaactaggtcactattgcagatgtgtgttttttttttttttaatgagatgatttgggtcaactttctatataccaactttatatatagttgtttcaaaggagactcagcatagcaaagagagagcatagtaaaaaattcatgggaaaaaagctgcaatcaatgtagaatgagtctttgaaaattagccaattaatctggctttgctttgtttccctcatgtctagggacttgatttacataaaataaatccagtgtgaacaatgaatacatacacagaaaataagagttgaataaaagattacttatgtatatgactagacacttcaaaggcttatagtgaaagatgaatcaccaaaggctatatctgaaaagaactccagacccatgattttcttaaaatgaactataatggattctgtaaggctagaaagggttcaagacagaactgtaagacttctcatatggtccactatatacaacagccacctgcttgctattgccattaatttctgccttaattctcttacagatagaaccagatacaacagccaccctcttgctaatgccattaatgtttgccttaattttctcacagataaagtcaagaccaattagtggaaaacacacagtggtaaatttcaactccttgaagaaagtttctaatgatctcatctgtatgatgaaggatcagctacctaggaaggtagttaatttgctccaactagtattagtgaagcttaagttggaggactgcttgaatctagaatcagacgggagagtcccttttgcactgagattctcaggattctttagcagccagtaacaagaatatgttacaacagaaattaacagctctattcatttagataagagaggatttgagacagaaccagcctttaactggagtcttttttttttttggcttcaaccttagcaccttctcccacctcaaggtgtgcattatactctagaggagacaggatgccttacagtaatcatatttttcagaggctaagttgctcttcccaaaggaaatacagtgccataatcatgtataagagttctgggttcagaaactatctttgcttggatcgccataacaaaataccatagactgagtggtttaaacaacagaaatttatttctgtacagttatggagtctggaactccaagattatagggtgccattgtggttgagttctggtgagggtgcttttcctctgttcacatggcctttttttttctctgtgtgtttgtgtgtatgtgtatggggcggggacgggggaagttggggagagaagagaacaaactatctgatgtctcttcttaaaagggcactaatcccatcatgagagtcctatcctcacaacctcatctaaccctaattatctaccaaaagccccatatccaaatatcaatactctagacattaaggcttcaatacatgaatgtggaggggaggcacaaatattcactctataacataaaccaaagtgtgaagcaaaggtgtggcaacttactagttggatggctttgggtaaattgtatacaccctctaaatctcatttacttcactggaaaatatgaaccacaataacttctcgatgaggttttggggtactgcataagtcaacaaacagtaagcatgtttcacataaaaaatagtccaagtaaatgtagccactactactgttgttgttatcatcatcgattccgataggacaaggatgaatctggaagttattccatacgctgctctttctgtctccattacctagcccctgccttgctttgctaattagtagttatgcttaaatccagctcaagttttactttgtctagaaggccacctttgattatccccatgagttagatggcacggaccttgctctttcatgacatactaggatgcatttgcatgcaaatagccttaccattgctgggtgaatgtgattttctttctttgattttgctagctagactctgagatacttgaagaaccacctggagttagtcccagcttcacagttaagggcatagttttccacaaactcctctcacttaagatgccagtcacaagtttggaggtctcttgggccactgtcacttttgatgagctggatacaaattcactggtccccacggacaccctcaggtttggtaattcaatagaactcctcccagaactcaggatcatgctatacttgtgattagaatacaaacagggaccaaccaaagtaagagatgcatagaaagaagtctgggaggattctaaatgtgaaactcccaccatcctcaaggatatcttaccctcttagcacatcaatatatgacaatacttataggactgccaaccgggaaagctcacctgagctttggtgtccagagtttttattgaggcttaattgtgtccactgattgactgaatcattggccatgattcactggccatcaataaccagtccctttcctttccccatgggttaatattaggcagctcaaagccccagccttctaatcacacagttggtctttctaatgcagccagctcccatcttgactcaccttattagcataatctatctgggagcccaccatgagtcacctcattagcaaaaactatcaggtgtatgttccaaggggtccaccatggaaaacagagacattcctatcacttgggaaattacaaaagtttagtggttacctcccaggaaccggggaaaaaggaaagccaatttttttttatgacatagggataatgattatgcaccctaagttgcttagtagatcacccaaaacatggtaagtggtccataaatatttgctaaatgaataacagagtgaataataaaagtcaagacaaggccattgttttaaccttatgaaaggagagttggccaattatctttatttttctggatagatttacttctggcatttgaagccctcacatctcttgttctatttccttctctactttctcctattttcattgagttcatcccactatcaccatttcttactactgtgaaacagactttgaatttctacttaaaaccctgcttttgcctttcacaccttttcaatgggattttacagttctgagagctgaggaagtgaaacagaaaacactgtgtaagaaaatcaaattcttctctcagtaacaaaggtgccttgatgcaggacagcatttcaattatggtgttcatttccttccacattaatgtcatttgagttgccactccattacttattattagtcaaatcaataaacaacatgcaggctcacaactcactgcatgtcaaactgaggcgtgcaggtggagctgttaatgcaaactgatatttcaggtgtcaaagggcacattggctcctgagcaaggtttgaggagtgcagtttggttcaacaaacaattattgagtgccttgtatgtgtcagatgttgtgctgggtgccaagaataccagtactaagaaggggcagcatcttcctgaggaacctagtgtcttagggagagtggggatggggacaggcagaatggactttccctctgaggtcctttaattcaaaaaaattcttcagggtctcttcatcaccttctgaagtatgactggtatacatcaaattgcatttattctactgcaccctgacactcctcatctcactttcctgctttatttttctccatggtactcaccaacctctgacacactatgtaatttgcctattggtttatttgcttgtctctcccccagctagaatgtaagctccatgaaggcaagtgtttttgtctagtcattcatagctgcatgtctagttttaaaatctgggtctggaacatggtaggtgttcaataaaaatgtgctgaattaatgaacgaatctactaaacagggggttcctcctgctgcccaaatgtctaagactcctcttgggtagtgaaaaagttgaaaagacatttatagtgcaatgatcctccagagtgggctggacatgttccttaagctgccaggccgcagggcagtgtccatggcctcagggagccggtgggggggaaccaatatgcagtcaaaaccagacaatataatgtgtgttgtctcattcaacccttgatgtatccctgtgagatagaagttattcttccaatttcagaaatgagaagatgggtggtgaaatagcttgcctacagccccacagctcatcagtgctagagctaagctttaaatccatgcctgagagatgccatggttcatgctttcctcatctatgatgttaggctgcctctatatcatatcttagtgaatgtgaaaagtaagcaagatgcatttgctccactagaagcacccacagcctaagctagacaaatattcacagaggaaaccacgttgattctgtaagatgggaccatgcacccctttgcaccattcaaagaaggctgaacagggcagatataaaaatgatgcagtgaatgagctgttggcttccctcatctccctattaactgtgccctggtgacttactcttaagagacatcaaatgaggaaataaatggctattgccaaataaacaaaggcaatgttttaaaagtctctgtcatgtcctgatagttcctgacgatgccactaagcccatttcaactgtcattaatcctagtctgactcattctggttaaggactactgctcccatgtctgagccaacaatgccccaggaaggtactaggttaggaaatattccatcccttgagcaggaagaagactctgaaaatagtatattgtctccatgccttgcttaaaggtggactggagttcacataacagcttctttaagtaaccatgccctctgcactccccctaaacctccttgccactttgtggctatttttcttggcagctagtttttactcctttctttcctgtgctcttctcatctcacttttatcagtgtttccccaaaagcagaccatgcttccagtgactcctcagccatgacagtagatttctctgtatctacagcttaagcaactagctgatgctaagacctctgcctcttaattgcccttgctccttctgcaccctggacatcattgctgaccttcattgaactaacactcaagatacccgctcgactttataattcctggcttctcctttggaggtgacagggcttccttacccttcattataccacttttagggtggttggctagtcaaccactgaatcaatccagatgtcttctaacatagtcacatggtttatgatgttttattttgtaaagcttagcagaaatgtagctccatatagtggttttcaaaccctataaaataatactgaatattttaatgcaagttagataattatcaatataaaaattaaagggaaatttcaaaataatggtaagaacagtttctcagaaatagtctccttaattcagaagttaaaactcagaagtacctggatcacactgagcttatggatccccggtatgaggaatgaacacaatggtttatttctgtttgattggcaatgagattgacatatttctttggctcccctgtgctattaaaaaaaaaagagcctctaaattgagactactgcccatttcagtaagaaatgaggccacatgtcaatagaatataggtaactacacatttataacactgggcagtgatgcagaattgattagcaagtgtaattgcagtaagtaagatgctttctgctcctggtactgatgactcgtggcatattgaaaggaaaaagcatgatgttcaaggaaatgagattctcaatattaagatggggtctaaaagtgcctaaatagaattggaaataacctaagtattgaatgagactgtagagtgtaatggttaagagcatgggctttaggggaagacagatctgaatgcaaatatctgttttaacatgtattagctttgaagtgcagcaagttctttaaattctttaagtctcagtctcctctataatgagacgagatgctcacagtgtttattctctaggtggttgtgagaattaaagcgatgttgcaggtaaagcacagactgcacttgtcacacagccagtgctaaaacagacaaaccaaccaaccccaagcaaaaaactatctatattgttttcatagttcaccagcaattccagttcctggaaggcaaccagtcagtgatctactgaagctaagtcagtctacggatgaggtgcatgtctgtaattgatcagattcagacctagagggaattggtaatctggtcccctcaggacagaatgtggagttctgcctcatgaactcaatctgtaagtatcaggaaaaatcttcccagaatgggaaatgtaaaaagaaagttccaaacatgcctaattatttctaacagattctaaaaacctctcaaaatgaattctgcataaaatgtaaatctaaacagtttgatgatgatccactgtttctacattattcagtctttaaacataaataagcctaggttttctttaaacaattctatcacagagttcaaataaagcaggtgtaacacacacacacacacacacacacacacacacacacacaaagatattctactttagctctctcgtatctggaaatcattcatcttatctgctgctcgctctccctctttctttttaagtaaacattaatccccacagatggtgaaccacggtaatctctgctaccagctgcagagaagaatttttaatgaaatgggaatttaaagggttttacacaaagcaccagaatctattccgctccttctcataatgctcaaattatttttactgccatgggttataaatgcatgtttgtattactgcttctgagagaaactgacctattgcttagaaggtgcttactgctttaagcgtgccgtctcctgcctcacccagtataagggtgtcaagtccccagtaaaaggcactcagtggttaagattacaagatttatcccagaactgaccttattttacactaccaaccctgcccaatctccacctgacttttgttgatatgtctcctgatcttctggcctcccttttaataaactccacagagttgtggctttgatttagctacatctctaactgaaagatttgattcctgtttttttctctccctagtccagcactgctcagactaaccacctggtattctgacatctcctgcttggccttatgaccttcctttacaaataacacttatgagcagctctgttggacaccactcagtgtttatagtcaccagctctcctcgattcttgcccaagagtgttgatatagaacactcatgatcattctcaaatcttttaagaaagaaattcaagttagctatgaagccaaaagtttttttgtttttttttttttacaaaagatgttataaaaggtgacatgcacacacaagtataaaaaatggaaaatcaagataatgtctaatttaagttaagctaattacttttgatgaaaacgtattactttaaaaaagatttatacacctctaaagccgttcaaaatatatcagcatagaaagattttgatgctcataataatttttatatataaattatcaggggggaaaagtcaaactccaatagaaaaaggactattttcacaaattaagggtacacatacaagaagaaaatattaataagattaagaagttcatctctattgatgttatgaaaatttcagccttgaacactaacttatggccacaaatccaatcataaaccatttcaaatggaccaggaaaagaccccaatgtcatggaaagagtagctgcttgaaggtcagaaagcctaagagctggtcttcctggtcctgccatcaactcactttgtgctgggggctgagttgctaggcctcttctagactcagtttcctgacgtgaaagtttactcctgaggcctcccaggtctgtttaatatgggatcaccaggaaacaacataaaacacagcagtaaacttaacaggagtctccctgtcagatccttgaactgatttcacatgaagaacatttagaaggcaggtttcagaaccctggacagagccattttgactcagaatgaggcacggagtgaaagccatttaggctgggtatagtggctcatgcttgtgatcccagaactttgggaggctgaggggagaggatcacttgaggtcaagagcttgagactagcctgggcaatagagcaaaccccctgtctctacaaaaaatagtaatataaaaaagcagtttgtctgccagagtaggaaaaaaatcaaaggacaagaaaatgtctgaatgtcaatttttaggaagactgtcctcaactacccaaagtggtgtttcttactacattatttgtgctcctaaagcactgtataaagatgtctattagaacccatgttaacatccctggcaatatcatgaacttcttaaagcagggcttctcaagttttagtgcttgtccgagtcatcacagccaatcctcagaccttcctgcccaaaccactctttaattagtatttactaaggccaatctattgctgcatgaacttttaggattcaagaatctgacatacagttatgatactctgtcttagcctctccttataaggatgttgacagccagaagaatcacattgaatcaaagccagtgatagaattctgtcaatgactgattatacttatacagttagcagcccctcctaggagattgccctgttgatccaagaatcaccaagagcttttcctgagccatagctttatagggcatgctatgctattttgcccatcatgaaagagctggcagtccacaaataacctgagggcaggatcacactctaaagtgacttgagcaaatgatttgtgtaagctaatgtgaacctcctatggctgtgctgtcatcaaaacactgggtcaaatcaaataagtccatcaaggtgctataaaatatgcatgcaaagagaatggatgtgatgttgttgagaataataaaacagtccataaaagctatgaaataaatcaactgttctttcaggcatggaatacaaaacaccacatacatccatatatattatatatgctgtaagcacacatttattatatatgagcacttattgacatgctagagaaaacaaagtgattaaggtgtttgcttcgtggaagcaatcgccatcaaggaagcattggcacagggactgaaacaatcctttgccctctgatcaatggctttgccaaggataatctcactggtgaacacttcttgtggggaacatgtgtatccctagaaaggatgaattacaaataagaaatacagggggtggtgggattattcttatgccatgactcaggcagctagctctaagatgttctaaagagattcttcgctttcctctaaaaacatgtttttaatatcagatcatggggtgaaaatgtaccctcacccttcagacaaaacattgaatggtagagatttcttctctttttccacccctccctccttccttctttactttcttcccactttacttttttttttttttttttttttttttgagacagagtcttgctctgtcactcagggtggagtggagtggcatgatcttggctcactgcaacctctgcttcctgggttcaagcaattctcctgtctcagcctcctgagtagctgggactacaggtgtgcccaaccatgcctggcttgcttatttatttatttatttatttaagatggagtttcgctcttgttgcccaggctggagtgcaatggcatgatctcagctcactgcaaccttcgcctcccaggttcaagcgattctcctgcctcagcctcccgaatagctgggattacaggtgcccaccaccaggcctaatttttttttttttttttttttttttagtagagacggggcttcaccatgttggccaggctggtcacgaactcctgacctcaggtgatccacctgccttggcctcccaaagtgttgggattacagatgtgagccatcgcgcccagccacacctgggtaatttttgtatttttagttgagatggggttacgccatgttggtcagcctggtcttgaactcctgacctcaggtgatccacctgcctcagcctcccaaagtgctgggattacaggtgtgagccaccatgccagcccttccttcttctttaaactttttttttttgagtgtactttaataccagttgcttctctacttgctatataagcaatgtcagcattacttactgagcatgtgtatgcgacagcccttttctatgtaccagagggtcagaaccacagacacaaatgaactaccaccactaccctgagagagttcatcatgtaccttcaaagactcatgtgtaggcaactaatgcaaatgccaagaagaatgaaacatgtaccttaaaagataatataaccaaaggaagaattactaatcccaactgcagagattttgggaaagggtcccagtgtcctgtacaagatggcatttgaattttgactgaggaataggattttttttattggtaaagaaatgggaaaagcatacccaggtaagaaacagcacgttaaagacagagagcagaaaggcagtggctacacttggtcttttctatggagaatttctgcagtgcctgtgctcccataagtctctggctagaatggaaatacatttccttccttttgatagcacaaagaatagggtttattccacagagtgacttggaaccttagtcatagtgttttttcagctttattactcacctacctgtgataagggcctctcccagcaaagtgtcttgaatcactaaaagtttgtctctccttcgtagggctcatagttgacacaggggccagagaccaagcaagttcaagagtagcaccccaaaccattgtttcttcagaaattatcagccccatcccaccagatttatgacaaacctacggtgttcttcccccttcagagacctctttgtatctctctgctatctgccttctgtcaagagatttccagtgtttagacatctcaatacatgtcagaactccaaatgtagaaaggattcaagtctccttgtaagggtatactaggtcctgaacaaatagagaccatttacagagctgtctggagctggctcatactagcttgcaagagccaattgttaaattttcaggaattttgcaaactggttaataccatattggtagcttgaaattggccatggttggagaatttatatcacagagactggtaaaggctacaaattaggactcttatttccagggagcttattgttaggttcttgccagtactgcaccaagtatgtaactctaaatagccctcaaaccttccacaccagttagccaaaagcacctaagtggctttcagaggattaccatcttactccatatgcatggaatgttggtgtctcagggagtgttgagagatatatatcaacaatggtgctgatcaaacacccactgtcaagagttcaatgtgctgtaggagaagaagagaagtgctggagtttagtttctaagcatgctggctctaatctttactaactgtgggatttgagggaagttatttaagtctctgcattgttttttttccctcacctgcaaagtggggaccataatacttatgtaacagcgttaaagattaaataaaataatatttgaaggtacttagaacaaggtacagaacagagtaagtacccaataaatgatgacaatgaggatagacaactaggttcaaatgctggcactgctacttttcagtttgtaccatcttgttaaacttatttcacttctctgagcctcggtatttttcctataaagaattggaaaaacataaactccttcacagagtgcagtgcattaggtagttggcactcagcaatcgttctatcatcctgatctcagtattacaggacctgggaggcaaaaaactacatctcccacactcccttggagctagcattcataagcaaattaggttccaccaatacaacgtacttgtttgaaatgtagatgcaagagagaggccaattttttgctttttggctttctttattggcaagcatggctgtggagatgttgggcttcactgcagcacaattctagtgtccatgactggccatgggtgtgctgagaggcaattgtgctggctggggtgggcctttggttctgctccttttgactgtggcagtagaagcagctctcctggtttccacagtgttgttctgggagtcactctgagtgtccagcctagtgtttttcttcagcccacccaatgatgtaaatacacatttcactgcctaaaatgaccaaaaacgtgtttgtgttctgcaactagaccctgattgataagcagtgtttgggaggattacacaagcacataggatagtgcaccagacctgcaacacttactattgtgcctggcttctattgtgtgttcttaataaatctgagttccttttcttcccagacttgtcaaccctcctttgtcaatggaagaaaaagacccagttaactatggcttttaatcagcatgacttgttttatgaacttcctgtgtagagtgtaggggaaatgtatatatttgcttcctgaagaatccagaccaatgctctaagtccatttttgtacatataaatacttgaaggataccaaacaatattacaagactgtggctttcatggccaggactatgtggtatattttccttgagagttaagaatcaggtttgggttcatttatgcccattcttagtggaggttttgtccaacccctaatatcatcttattaattccattaaaaatttctcatctgagcatctactcttggagtaattattaaaaaaaaaaaaaaaaaacaaaaactgaaaactcagctctcctttatctgctcttttattcaagtcattttcaaatttgtttcccaggcaatagtaattgtttcagtaattaaaatgtcaggaggcgggcagagttgattagaatagcctctgaccacatgcaccaggaaaggcatatgagagagcaccaggtgacctcattattaacgtggtctattatattaaccttgttacacatgtaaaatgtactgaaaacattgatactcagctcttccttgttttgtttctgatacctcaagcaatagcccactattagaattaaccactgcaagattattacaaaatgaaggacagaaaaatgaaatgtagatatgagttgaaataactctaacaccaaattcagcatctatttctattactcatatagagtgtctgttttacccaaggctattgcaacttaaactgggtctttcctcctgttgacatgtctccacgcttacccttgggcatcctgtatagggtagggtgaggggtagtgagtaaggaagatgtttttcttctgtttttttttcttttttttcttttcttttcttttcttttcttttcttttcttagggtctttctttgttgcccaggctggagtggtttgatcatggttcactgcaggcttgacctcctgggctcaagccatcctcccacctcaacctcccaagtagctgggactacaggtgtaagacaccacccccagctaatttctaaatgttttttagagatagggtctccctatatttcccaggaaccaggagagctgcttatactcttatactgcccaagttagtcttgaactcctgggttcaagcaatcctcccatactggccttccaaagtgctgggattatgggtatgaggcactgtgcccagcctagaaaggcagttttgacctggatctagatctgtgttcctagactgatggagaaccatggtattattagaaggttaccaagtcaccgtgatacacttaacactttcaagagtcaacacaatggaacgacaaatacttttgaacttaaaagtcatttaagctctgtttacagctcacagtccttcttcatgtggaggcagctttatgcaatggggaagaaggctgtttctgcagtcattctaatctgggttctattctttatactgcaccccaatctctgggacagagacaagtctctcagccctgttcttttgtgtttttacttatttttaattttttcaacttaaaaagttatttatattactaaagtttattttttggggggggtatatagttaaatgagttttagtacatgtggattattgtagccactgccaaaatcaggatacagaacaattccaacacccccaacatttccctcaagcagtttcttttaacttaactccccttcaccaccctctgacacttcttactcctggagaccgctgattgttatctattcctatttcttttttccagaatgttctataaatggaataatataaaactttttggagtcagtttccttgacttagcacaatgcctttgagattcatatatgctattgcatttatcaatagttcatttctttttattgctgagtagtatcccattgcatggggaccatggtttatctgtttaactatggaaagacatgagagttgtctccagttgtcagtgatatagataatgcagctataaacattcatgtgtaggttttatgtgaagataaaattttatttcttctctcgtttttttttttttttttttttttttgaacaaggtctcaccctgtcacccaggctggagtacagtggcatgatctcagctcactgcagcctggacctctcaggctcaagcaatcctcccacctcggcctcttgagtagctgggactacaggtgcatgccaccacacccagctacttttttttcatctttttttttttttttttggtagagatgaggtctctctatgttgcccaggctggtctcaaactcctgagctcaagtgatcctcctgccttggcctctcagagtgctgggattacagcatgagtcagtgcacctggcagtttttatttctttagtgcaaaatgtctccaccttgaatttaaagtggaataaccctttgttgtggggaatgtcctgtgcattgcaggatgtttggcagcatccttggatctatccattaggtacccgtaacagcctctgaaccagttgtgaaaaccaaaatgtctcctcacattaccaaatgttggggggcaaaattgacttcagtgaagacttcagtgaagaattcagtgacttactgaagacttcagtaaaaactcataagcaagatcctggtccatatggtagtatatgtttcactttaaatgaagctgccaagctatttttcagggcatctgtaccattttgcattcccccagctatgcctgagagctccaattgttctgtatctttgtgagtacttgatattagcaggtttcttaaattttttgccattctgtaattagggagtcccttgattttaaaatcaggaacgacaccgtggcaaatattagtgcatgcagctcactaatatttctagttctgaaattctcctcacttgagaaagtttcatttcctgctccttttaggttgcatgtgactatatgaattggcttggctagagtgaaagtggggtgggtcacttcatggtggacatgtgtaggagctgttgcacactgctccatcttccctcccccaagctttagcaaccacctacagtccagatggtggagatgtcatcagccaatgttgctgagtagaaatgacatggaagagagtaccctgccaaacctcaaatggacatgaggtatgtgtgagaaataaaactttgtttaaatccactggtattttgagattgtttgctagcttattttgactaaatcaaattactatgtgatagactcattgtgagcatttatgtgacaaatgtgggtaatgcatttaacacaattcttggctcaaaaggagttcagagtgaatgattgctactattataactatttactcttccctgaccatcccgcatcatgatgattctctctttgataaactcacagcttttactctctgtaatgcattagcagaactactttagcttcttcaatgcaccttggcaataaatcaaattcaaagatatgaagttaagtacccatttcattgaccacctgatcatcaggtgtgctggtacaccatctaaggttcaagggggtagcatcactgtattggtgcaaacatctctaaatgacaattagtattactaagtcattttaaaacctgtcttctataggtcagtgtatagaaggtctttcattaaccagcaactttttcacattttttgtctatttgtccatttcctaagaatataaagagaggtaaagaggtataaaaacacagtgattctcggctgggtgtggtgactcacacctgtaatcccagcactttgggaggccgaggcagacggatcacaaggtcaggagattgagaccatcctggctaacatggtgaaaccccaactctactaaaaatacaaaaaattagccaggcatggtggcacacgtatgtagtcccagctactcgggaggctgaggcaggagaattgcttgaacccagaaggcggaggttacagtgagccaagatcgcaccactgcactccagcctgggtgacagagcatgactccgtctcaaaaaaaaaaaaaaaaaaaaaaaagaaaaaggaaaaaagaaaaaaacacaatgattcacaaagctgatagtgcatcagaattacctccagaaagttgggaattctggttctaagatttaaccacactgaggcctaagacttaacatattttttaaagttctccatataattctgataagtagacaagttcagaagcccctgcattagttgtagaaatgtaggaagtatgaccctaagaaacttggcaagacgcagaaaaactcctgcaattaccccagctatttagagatgtgaagagtttctattacctacctggcagaatcacaatctgtcataggatatttttcacattattgttcaagattgaaatgtatccctggctctgatctaactggcagacagacctgaggaagagaactcaactctgtaggcaccagggttcatatctgcaaattgtgtgagttgggcttccacctataaaaatctttgatccattatcttctgtgatccaggtattcattttaattactcaatcagattattgcatgtattgaggaatcttctacattttccaggattttaatacataatatgagccaaagaaatgtttttcaagcttataactattcattcactgacaaacagggtgctcttccaaggaactctttttcaattttttcatgttcatatatatatatatatatatatatatatatatatatatatatatatatatatatatatatatgggtgtgtgtgtgtgtgtgtgtatgtgtgtatgtgtgtttgtgtatatatatatataatgaacaaatataacaataaaattctataattcccaaatctcaaaataaccacttttggcattttagattattgttttcatttttaaataaaaacatatactatataactttgtgactttcctttttattttccattataacatgagaatttccccatgattcaatttattcaaaatggaacttaaacaactgaatagtttcttatcagttggttatcacacttgtgtagccatttatctactgtcagatatttcaggtggtttctaattattgtccactgaacatggtgttacagtgaattttttcatgtgtagctctatttctttaggataaactaccagaattggaattactggggagacaaatactacaaatagctgcataagcctttaaaatgtcctattttaattattttcttcttctactcatctttcttactgctcccaagattatctatctaacccagagattctactctctattctacttcattaaatctactatgggatccccattcaagacagtggagctgagcacacttatttgataactccagacttctcaatattattaagatgaacaaaaaggtctaaaataaagacctacatcaacgaaaactctagaaaacaggagtagatagaaacgttgagaaacttctgaatgataaagagcaagtaagataggcttggctgaagtgaggaccagagaacagagtgtcccaaagctgaccaatgaaaagctcactgcagagaggtcattgctcccaacagaatcctggagaaactgtgagcatgaggagcagaaatgaaatgcaaaaagtcccctattaaattcttcttatccacattagggaggagaattcttctaaaaagaaaaggaagtgacatgtgtccgtgagtgaacttcactgaccaatggcactccttgagtgaaggtgtattaatcatgtcttctattttctgtatgctttgatatctggggcctaggtgactcaggaggaagtgcccctccaagggttagccaattcctagacataatgaacaatttgcctctaagcatgcctttcatatgcaaactggccaatccagaatccacacctcaactatcttctttatagggctctcatactccaggccactaaccacctgctctaatcaccccagagcctgctgaaactaataagccagtcctaaccctgctttccttgccttacctcttccagcagaaaccgtaataaggctcttccccatagttccctcctccctttattcctcctgaccaaccctggtatgtccccgtgtggtactgagtagattggcatgccccttcctcttgggaactgtcagcaaaaaaatatttttttttctttttttttgaggcagggtcttgctctgtcacccaggctggagtgcagtggcatgatcttgcctcactgcaaccccatttccagggctcaagtgatccttcctcctcagcctaacaagtagatgggacggcatgtgccaatgcacccagctaatttttgtatcttttgtagagatggtgtcttgccatgttgcccaggcttgtcttgaactcctgggctcaagcgatcctcctgcctcagcctttcaaagtgctgggagtataggtgtgagacattgtgccctgccacaaaatgtcttttccgtggcaattattttctaatctgttgggctcactgcacctcacatttttaataccttcccaacttaactgttgactccctgccaatctcctataggaaatcttatttattggcatatctggtaagtttcagtaataaaaaaaaataagtaatgaaagacttacgtggaagcatgaaaaaaaccaatgttcatagtgcattgatagatgaagaaagaaactaaaagagggagcacagaacttatttctacaaatatatgtagaaatgtagttgtatttcaaattagtggtgattagacaatttatttaatatattgagtaattagaaaaaagttttatcggccgggcgcgggtggctcacgcctgtaatcccagcactttgggaggccgagacaggcggatcatgaggtcaggagatcgagaccatcctggctaatacggtgaaaccctgtctctactaaaaattaaaaaaaaaattagccaggcatggtggctggcgcctgtagtcccagctactcgggaggctgaggcagaagaatggcgtgaacctgggaggcggagcttgaaatgagccgagatcacgccactgcactccagcctgggcgacagagcgagactccgtctcaagaaaaaaaaaaaaaaaaaaagttttatccttttatcatacaatgaactcaaaataattttgagatagattacggatataaaaaaccataatgattaaattaatagcataatgtttttataatcttatgctaaagaaggatttatcaataaaggacgaaacccaggattcacaaagattcatgtattttgtattttaaaaatggaagctttggtacaccagcaaaagtcactataaacacattcaaaagacaaatgataaaaaagaaaaaatttgcaacacctaaaacataagaatggttaatattcataaagtataaaaacataaaaatcaatataaaaaagacagcctatctgatagaaaaaaagaacggggatatgtataggcaatttacaaacaaatacaaaaggcaaacatatgaaaaggtgatgaacctcactaacaaggagacacaaattcagtcaataatgagagggcatttttcccatattaagttgtcaaaaattataaagactggtaatatccaggtttggcaaagctgtgtgggaggtgggtaggaacggaacatctttcactgttaatgacaggagaacagctttggagaagacaaataggcagaacccatctaaactacaagttagtgagtttttggtttggcaatttcacttctaggcacatatcctattggaatgcttgctcacatgcataaagacacatgcgcaaaatgttagaagctatatgatttgtaatagtaaaaaagtggaggaatgctaatggttcatcaatagcccacagttgaatattgtggaaaacttcgcagtggcaacaaaaaaaaaaaaaaagaaaagaaaagaatagagttacacggcctgactttaaaatagatgcgtatgttatgctgttggctaaaaagaaagaaaagttgcaaaatgatataacatgtacagtattcgctatgtatatatgtgtttataaaaatattttataaaagatagctatttatatatacaaaatataagtaattgatgaaaaactgtttcataaaattatcgtgttatattatcatatcctttttcatttttcccagttaatcatttgaattcccataagccttagtacaagaaaatccaggatctcccacttgagattgcctatccccagaattgtcccaaaacctcagcacctcattaatgccaattgtaaattgtgtgtgtgtatgggtgttgggggaggatggcaatccatcttccagattcaaaagatggaactaaatggggctggctttctccaggtatcacctgactacatcgacctggcatagtcaagtctatgatggtaacacttgactgtgataatgccgcctgatttaggatgtcaagtacttggtactcatagggtgatgctccctatggcttttgggctgagttcagctgtgagtgtggctctctgtgctcagctctcttgttcctacacaaacaacttcacgggtctctgccagccagagcaccgagtcaagactggaatttgtcagcttacagacctaaccttgccatcctccttccctctctagggagcctacaaagaggtccaggaaggttttctttttaaaatgtcagaagttgctatttgttctcctttctcagaatagagtaatagtttggcacttctctcttgaaaaaagttgtgctcccaacagatataatcctggctgggtacatcttgggtaaggtactggtggaaaattttgtttgtatgatagattttatgtgtacagtgcaggtctagaagaattcacactaaactattagtggtgggtcatctccttttgggaaggcaggaagtaatgggagtgaaactaagtaactactgtcagtcacatttactccttagcactttggagtaaactgtggtttgattttattttgacagggttaacaaacttggacatacacacacatacataaacactcatgcaaatcaacttaaaaataatacaataaattttctttctctcttctaatttttcgttttctgttggatcattcttctctgtgtatactcaatgttctgttattcttcccaacttaaaaaaaatcccctcctgatcactcttcccacttgtgcttttattactccatttctttgagctttttacattaaaagtcctcaagagttatccatattcatttgtaaatcctttcctcccattttctcatgaatatatgctaatgatcccccatcccactcacttctactgctcttgttaaggccactaatgaatggcctccaagttgttgactccgtggtcattttcagtctttaccatacttgacccatgaacagctccttctgcctgagaaccctttcttctttcatcttccaggataccacactcttccagtttcccagctccctccctggcagctccatcttaagttcccttcctgattccacctcagctcctccccatcttaatgttaggtgctccagggctcagtccttaagccttttgtctaacatgatttcattagccatggctttaaatatcatctatgttaaatacacctcaaaatttttcttttagcttaaccctgtccaggattctaggtttatacactctacctcctatttggggtctccacttggatgtttgacaaatatgtcaaacttggcatactcaaaactggctcatctcatggtattctctcccaaatctgcttttcttatatttttctgcaaaatgataaaggataacttcaatcccttcatgctcaagagaaacccttgtagtcatccttgacccttcttttttctttgcattccatatttaacctatcagcaaaatttgttgactctaccttcaaattatatccagattctgaatacttctcactagctcttctgttgcctccttgggtcaagacacagccaccctttccctggattgttgtaatggccttttcactggacacctggactcagtctttgagaaccttcagtaattttcaacacagagtgatgctgtaaaactctaaaacagatggccactttgctcgcagccctacataagttcctcattgtactcaaattgaaagcaaaatccttgcaatccctctcacctcattgccctctactcctccactctccctctccagcctccaagctttctctagaacgggttgtcttgagatctttgcatctgctcttctccctgcttgggctattctcccctgcaaacacccaatggcttgcaaatttaactcatccaggtctttgactttatgttctattctcattgaggctttccatgactatggtatttaaaatagcacacagcttctcctaccctctctgtatttccgaaccttttcagcattttcttcttcatagcacttagtacaaaatgattagtgtcctagtgctgtgttacaaattagcacaaactgggaggcttagcgcaaactgggaggcttagcacgacagaaaagtattgccccatgaactgtgaaatcaaggtgctggcatggttggttctttctggaggttctgagggagaatctgtgctgtgcctctgtcctagcttatggtagtcaccagcaatcctaggagttcctttgtttgtagacacatcattccaatccctttcctccatcatcacctggctttcttccttatttgtctgtattcttgtatcttcacatgccctttctctatgaggatatcagtcattgaaattagtgcccaccctaatccagtatgacctcatcttagttcgactgtatctgcagactatttccaaatgaaatcacattcacaagtatcagggattaggggttcaacatatattattgggagagacaattcaacccctagcaccatatgacatacaacatatttttacttcattttttgtctttctctttatacaagaatgcaagctctaagaaagcccagagttttgtctgatttttttttcactgctatacctgggtgggatgcaacccataaagacttgttgaatgactaaatccctctgctagctcctcatgaccaagaggacgaaggtccaaacaatggatacagcattcatgctgttagacaaactgggcctcactgaagttttcacccttagctttcatcacttccctcagtatctcctgtttctactaaggtgaactcctggatcttactcaaacacgttcacaactctccttatttgctctttctctccccttcacccccatctactcctcttttcctctacaacacatatttctctgttaaaatcttacacattctcctaagaccagctcagttctcactctgaaaccttccatatgaacagttaacaacctctttttctgggtccctttcagttagttattatttttctcactagaaattttatcatcttagcacatgagtgcattggtgtagaatcatgacaacacaaatcttctccattcaactgggagatctttcagacaggggccaatgccttccttatctcttcatttttccttcagtccaacccccagcatctatccagtgcttggactgtaacagctgcatgctaaacacctgttgaccaaatgaaagaagtagggtagatttgccttcttaagctttgaagtaacagcaaatataattttggccactgggccccaggatatatgtactacatagttagccaataagtaggtgggaaagatgaggtttctaactaaggcattttggaagttacaataaacaaaagccttcgagaaaaggccttagtcatggtcagagagtgcagagagattagcaaaggagaacacaaaatagactactcaggaggacaaaaaactggacttaagctgtctaatagctaatgcccatccagtaagtgaagggcagaatcctcccacagccacctgcattattttctaaagaccatcccttagagctgtttttagaggtattttgagcattgtgggtgaatgtggcagtgtagtcttagatatagatgagaaggagtggctataaaaactgcaccttccaactataaaaacttcctggagtaacaattccctcccacaatgtaattgaaaagtgcaattgatcttatctttaaagagtgttctacaaaatcttagagtcattctgttagaataacttgaatgcttttaaaaaacctaattcctgggtctcatctaagatgccctggaatcagatctttgcagtagtgtactagaatttgcactggcaataagctcccaggaaaatatgagaatactaatatttaaggattcctacattaaggaaatccatccctaaatccatgtatatgatttatcatggtcagccattgtgttggttaattttatgtgtcaacatgactgcactaacggatgcccagataacaggtaaaacattatttttgggtgtctgtgtaggtgtttctggaagagattagcatttgaatcagtagaactagtaaagaatattgtcctcacagaatgggccagaattatccaatctgttgaaagctcaaatagaacaaaaaggcaaaggaagagtgaatttgttctctgtttgagcttggatatccatcttctctcaccctgggattttggtacttcttgttcttgggccttcaaactagaacctggacttatgccattagctccccgtgtgcaccctgctccattctcacgccttacttatgccatcagctccccctgtgcaccctgctctattctcatgcctttggacttgggactgaatcacaccactgtctttccaggttctccagcttgcatatagcagataatgaaaattcttggcatccctaataatgtaaaccaattcctataataaacctcctcatatatatatcctataagtctgtttcagtagagaacttcggctaatacaatcttattcttgaaaatctggaaaggaaaaaaatgaaaaaaaaaaacccacaagtctttgtatagatttgtcttcaagttagggtcttcttaaataccccctccaatagaactgctcttaaagaatagacacgcagaaagaagcctctaggctgaggcaagcaggcccacaaggctgaaacacagaatggaggagagcagcagttcttgagagcttgttagcaatcaaacctgaaggcaggcggggactctgagatgagtagaaactctgggcagccattcagtatacttttcagcaacccagaactaaatgtaggcttcagatacagagttatattatgggaacagcaaagtctttggactaacaaataacatggttgggatccttgctctgccaattacttttggttcagcgaatctgggtaagttatttacctcagcctcagtttccacatctgcacaatgcgaacaacatcaccacttggctggcttattgtgaagataaaataaaataaaagtgtgtgttggctgggcgcagtggctcacacttgtaaccccagcactttgggaggctagcttgtaatcccagcactttgggaggccaaggcaggtggatcatgaggtcagcagttcaagaccagcctggccaagatggtgaaacccctaaaccccttctctactaaaaatacaaaaaaaaaaagaaaaaaaaaaaagaaaaaaaattagtcgggtgtggtggcaggtgcctgtaatcccagctactcagtaggctgaggcaaagaattgcttgaacccaggaggcagaggttgcagtaagccgagattgcgccactgcactccagtctgggagacagaatgagactccatctcaagaaaacaaaaacaaaaacaaaacaaaacaaaaaaaactgtgtgtgatcacttcacatgatagttgaaacttggtaagtccctgaaatatgacatcttctagatttcttttccttgtctccagtaagagataatcagaaggtggtattgatttttaaaaaaaaggagaagaaaggaaagaaggaagggagagaggaagtaacaaaaggaggaaggaaaaagaaatagaaaaaaagaaaagatacacaaatagaagaaaattagcttggttcagagttttccagacaaaataagctactttcaaatatcatcttttactgaacatttacattaaaatctttaagcggtacaccatgccattgtagatttctccaaactaaataaaaatggtaactaaatagtagaataaggattactttctatagctgagaatgaaataatttgaaggtaaacattggaaagctcttaaagcatcctaaattgtcttttcttccttcaaatgtcaaaatacctatctcaatagatatttttaaattgcattcctctttcaagatccttctatcccttgtgtctcttgcttaggaatgaaataaataacttagttggaaatgacataatctctggtaggatgggagaggagtttaaataaattccaatttgaccgtcttctagatcttggtagatactgataatgctttgccactgagatttgtggaaactggagagaaaaataatctttgtagtgtgttctgctgttcccattacctattgctacataataaatcatcttcaaaattcagtggcttaaaatagttatttattattataactcatggttccatggattgactgggatcagctgggtgactctcacttggggatctttaatatggttgtcgtctggagatacattatgtgaaggttctctgggatggctgtctaagatggctcactttcaaggctgacagttgctcttagaagttggccgggagctcagctggtgctgccaatcagaataacaacacatggcctctctaggctttgtcttcttgggcatggtggctgaattctgtgagggagagtcccacaagtgggcatttcaagagacccaggtggagattgcaaggcttcttatgacctagatgtggaagtcatgcagtgtcacctctaccacattctgttacttatacagggctagtcaagaatcaagcaggtgggcaggtatggtggctcatgcatgtcatcctaacactttgggaggctggagaaggcagattgcttgagcccaggagctcaacactagcctgggcaatgtggtgaaatcctgtctctacgaaaaatacaaaaaaattagctaggtgttggggtgaacacccatagtcccagctaaccaggaggctgaggtgggaggatcacccaaacctgggaggtcgaggctgcagtgaaccatgattgcgccactgtgctccagcctagatgacagtgaggccctgtctcaaaaataaaataaaaccaaaccaaaccaaaccaaacaaaacaaaataaaataaaaaagaatcaagtgcacaagtacttgagtacacaaggacatcactactgggaagcatggttcattgggggccacctttggagactagctgctaggcttgcctacattataattaaactttcctacccataggagcatttctatctttgtcagatcaatagtagcatcacttaccatttaactacaaatttctaatggaagtttcacctgcatgtatgaaaacaaggtttccatcaaaggtaacaaaacaaatgaccaaaagtgtttttgctaaagaatttgtgaaagctttttcattagctgaacacccactggagacatcatgctttgagactttctgacctcaatccctagacagaaaaagagttggtgtctcccagtttgcaagcagtcctggggaagtaggttggcaccgatgaaccctttacattgattatcttaggcagctcaattcacttagttttcttcagttgaagaaaagggggtagcaacaccggataaattttaggggcacttctctcctgacattccattaatgtgccaatggcttagtgttttgcaaggaacttcacagaatagaacagttcggttaacttctggttgttgtaacgcatttttacttaataatctctcttgtctgtgtttcaggtcattcatggggatagagtaggcagggtgtgtagaatcttcttccatcacagcatgaaactgagtgaagacttcagaccatgacatctgcagatgttgggcttcagttgtgggttcgtaaattctcgagtttaagacttgttgccatttgctcaatatttttgatccttggcttcctcatttgtaaaaaataccaaacccataattttgttggaaggaacaaaggagctgaactttaagaccctaccctaggtctccctactactgggctattttgttgtttgtttgttttttttgccttttaaacctcgcttgaatgatttaatagttatggtgtacctgtagcttttagttaccacacatctctttgagaagtagtcagggtatgaataatacacataaataaaaaatgagtgaacagtatattaaagcaaagtaagcctgtttgaaaatttggactcaaaccatagtttcaaacccgtaaaaaatatttattgggtcactagtatatatagtgcactgtgctaggctctgtagaggactgaattcataaaagcaaaagctgcctttattctacttatccagaggttactgaatttggagctagttgacagttatgccaggagaacacaccagtctgcctgcctgtcaaggagagaattaaaaacttgtttctgctcagtgcacagcagacagcccggaaagagtcttatgaaccaagcactgcaaacaaggccatatctcctcctttccagatttttataagtaggtcaacaatagttcaggaaagatggaattccagatctaagaaaataattttgattgaaaaagatgcaaaaggcagtagagacaaataagagattccaatgattatcagtggtatttaaaacaaaacgaaatagcccaaaacaatcacatctactactacgcattcattaccacggagacactaaggatccaccgggccaaggtgccatgtggggactgaggtggtgtgtgtgattgggaggggttgttggtagtgaataatagggcttttagtaatgcacaaagggagagatgagacagatacccaaataactgtaattcaagagagaaagtgctaagtattaaagaagactgaagttctaaggaacgagaaatagcaccactcaggcaacatgaggaaaacctgttgaatggggaagtcagacttcagcctggccttgaaacagaggtggtaatagttagcgatttggtttggatgaataatagagtttgtgaatggaagaagtggaagaaaagtctggaaagaaggttgagaccagactctagagcatcttcaagattgatgtacagggtttacgttttacttggaaagtgttatcacgtaagaatgcagccagctgcaattgatggaaaaatagacagtggtttacatgagaaagcagttggtttactctatggaagaagaagtcaggaggcaggcaggtgagggttggtatggtggctcaggaggccatggaagacttaggctctttccttttgccccgccctgtcattctgcacaggtagctttcactctcacgatgggaatatgactgctcctcttccagccccatgtctgcactataagcaggaagaaggtttaagggtaaagggagggccaatcccctcccaagactgtcacctacatctcaccggtgaggaatgtatcatgccatccctacctacatggggggctgagaaattgagtattttctattttctgagtctttggcaaagaaagcccagggaaaaggtaactatgagtcccttttgagtagctagttcatggcattcgccagagaactattatggtttttgagcaggggaataaaacactgcttgatgattaatttggctgtaatgcatggctggacttggagagaatagttacaaagagaaagatgagaactcaaggtgcagagacatgaagtgccggattcatggtcctgtatgagtaagtggtggaactgggatttgaatccaggctagttgttcccagcctttttccacctatctctcaaagctactcagtaaggactttaacagaactatctcttatatagagccatctgcataaacaacaatgctaggaagccattaattcatttattccttcaattctgctttaattatgtatactgttgttttataaacaatcctgggagatagtataataaaaggaaataatgagaattcagagaaaggtagagataagttcaagtccagccatttctcttgccaatggtgtgattttgcatgagtcacataaattctctggctttcaatatccttagaggaataacaatggcagaaatgtataaaatgagataatcttgttatggcaaacatatggccaatatgggttagttggcccagcctccgttccaaatttattctccctagccaattccggctaaggcagttggtgtgttactattctggccaatcagacataggtgggatcagctatagtctcaatgatatttttacttttctgattcaggttcctccattttatactcctttcttcctgctggtgggcatgatggctggagttgatgcagtcattttagcacaatggggaaaagaccacgtgagtactagaggcttcattatgaataacattgaacaactggaacaacgctagcagctgcaaatcctcaaacttctcattatgtgtcaaaaataaactacttgtattagacactatggctttatttttcattacttccagttaaaaacacttaaaattgatagtttataaaagcacttggtacctactttatgcttaataagtgatgtttattattattcttgtcatcatcagtattattgttattgtttttataagttgcataatatcaagttacaggctaacagataaaaagactataatcaaaatacataaacaaatatgtgatatcctaacgaaaaaataaaaataaagccaccatgaaggattgagagtaacatgaaaccacactggttctgcgtgggtggaaattgtctgtacggatgttggaaaaatccacgctctaagtccgaagccagggttatagtaaagggcaatctttccagatgcagaaacatagcaaccatggcaggggatacgggaagggaagcatttctactggggtattttgagtgatgactgtaaaattagtgcttggactatacaagagggattttgtctctttgacttaaatacagtgttcagtgtttatggggataaaaagtagtcaaactaccaaagagagtctggtttctggtaaagaatttagaaataggaaaagctaaggtccatggaaatgaattctctgaccttcagacttctctagccaactactgagtgagataaactgataatctataatgtatgctaaattttcagaatgaaactaaagtgcaaaattgaattgtacgaacaatagacaccatgaagaattaaaaggcttattttttaaaagtaactccagtgaataacatagcccaggcatagatatgcttgccaaacaagcaattgacccagtaaacaacatggttattcagacaaaatcagagatcctgtatttgtgaggtcaatagatcaaaatttttatcaacttatctattgtctctatatattcacgtatacatttttgaaaaatatttgttacaatttacaaaaacacatatatggcaatagaataaacaataaaaaatttagaattcaagatagttgactatgcatgtctccaacctcatatcccattaaatgacataagatattcacaaagaggacaaaattataacaccactagaaaagtatagggagcttgtgtttggcagatctgaatactgaggaatttctgaaagctgtaaggcagatagcaacacattgactgagaatatcaaaaagctaaacaattcataacacaaaatggaagaaagaagaggctttctcagcaaaattctgggggactccaagatcagggggcagagaaaggtgagggatgactgaataaagagacctgaaagagctgtcccgttcaaaaggctgaccccacgtttgtcccccaagcaaagctgaaagaatagcttcctgaataaactggtgaatcatctgtgagaggtttccagagtgggcactagcattaaaaaaattgcagcactgaactcccaagtaactttgattaccataatgggctactaaaggataaagtgtcatacctcctaaagaaaagacttcccagtgccccaatccctgaaaggagccagggcttctgtcttaagaatttatacccattgttggagatacaatttttttcatgtaaggagaattacatttcaggaaccaattctattttcttagatcctgatttataaatgtaaataagtaattttattcctccaaaggaatgccaccctgttgacatcttgattttagccctatgaaatccatttcagattctgacctctaaaaaattaaaataatgaatttgtgttgtttgtagtcactaagtttgtggtactttgttacagcagcaataggaaactaatacacatggagaacagactcaatagacccaataactctgtagtgagaaatcacaaggaaagaaagagatacagatggagggtatgatgtaatcaaataaataatagaaagactgacttgaagctggaaagggacttgagttttcagagaagaaaaggccaactgagtcccttatggcaaaattgtaaaaaaattggaatccctaaggataaagaaaaatcttacaagctcccattaaaaaatacattttttggtataaatgaattattattctcatcactgagcccattatttatttgagctaagtattttactttaatcttcaccacaccaggaccctataccacactcttatctacttgcatgcggatatggaaaaagaggatccctgaggttatgcagttctacagttagtaagtggtagaaatggaattaaaagtcaagttcagaaacatgggattctgaagacaattacattatttgctagcatcaaacttctcatttacaatacagaaaacaggaaaacaacagaccaatgcctgtaaaaagttaaagaagtacgttttcaagctcaagtcctatcattaaagtatggggcagaggggaatgacatttttagacatacaagaacatagaaggcttaccacccacataaccttttctgaaaacaaagcaacaacaaaatcttcaggttgtacttcagcaagataaagttgaaaaacagaaatacataacataccaataaaatgagcaatgatatcagtaaaacttatagttaatactaagtaatggttgaaaatatggcagtgaaatttaatggaattgttaagtaggtagtcataaaacagaagaggcacaaagtaaaaaattaacaatctggaaccaaaattcaagataatttttaacaatatgaaagaggtagtaaggaagaaacaaagggaagttataaaataccaatgatacaacctgtattttgtttaagcgagattgttgtagacactgctttatttttatttggacaggaaaacaatttctgatttcggcaagtttaaggatgttcactagcagaacaaaaatgtaaggtgaaaatttcaaactactatgaggtaaactgtaaataaaaaataagaaattaaagaataaaaacataaaataagaatatatgagacaatataatgaatatcagttgaatttttctaaactattctagaaataggcaatgttccatgttatttttttaaaaaaatcaacttcatcaaggtattatttgcatacaataaaatgcacagatttttatttatttattctaagcttttatattgggttcaggggtacatgtgcaggtttggtatataggtaaattgcatgtcatgggagtttggtgtacaaattatttaatcagccaggtaataagcatagtacccggcaggtagttttccagtcctcatcttcctgtccccctctaccctcaaggaggccccagtgtctgttgttcccttctttgtgtccacatatgctcaatgtttagctgtcactcatcagtgaaaacatgtggtatttcgttttctatgcctgaattagtttactgaggataatgagttcagctctatccatgttactgcaaaggacatgatctcattccttttatggctgtgaaccaaggtgtataagtaccacattttctttctccagtctaatgttgatggacatttaggttgattccatgtctttgctattgtgaacagtgctgtgatgaagatacgcatgcaagtgtctttatggcagcacaatttatatatctttggttatatacccaacaatgggattgctgggtcaaatggtagttctgttttaagttctctgagaaactgtcaaactgtttccacagtggctgaactaatttacactcccaccagcagtgtataagcattcccttttctctgtaacctccccagcatctgttactttttgactttttaataatagccattctgactgatatgaggtggtatctcattgtggttttgatttgcatttctctaatgattagtgatgttgagcattttttcacatgcttgttggccatgtgtatgtcttcttttgaaaagtgtctgtccatgtcctttgcccacttttaaattttttttttaatttgtttaagttgcttgtagatgctgggaattagacctttgtcagatgcatagtttgcaaatattttctcctattctgtaggttctctgtttactctgttgatagtttcttttgctgtttagaagccctttagtttaattatatctgacttgtcaattttgttgctgttgcaattacttttagtgttttcatcatgaaatttttgccagagcctatgtccagaatggtattttgtaggttatcttctagggtttttgtggttttaggttttacatttaagtctttaatccaccttgaattgatttgatttttgtatataagtgaggggcccagtttcaatcttctgcatatggctagccagttatcccaacaccatttattgaatagagagtcctttctccattgtttttctcaactttgtaggagatcagatggttgtaggtgtgaagctttattttgatctgtctattctgttccattgttctgtgtgcctgtttttgtacttgcaccatgctgttttggttactgtagccttgtagtataatttgaagtcaggtaatgtaatgcctgcagctttgttctttttggttgtgattgctttgcatattcaggctctttattggttacatattaattttaaaatggttttttctaattctgggaagaatgtcattggtaatttgacaggagtagcattgaatctataaattgctctgggcattatggccattttaacaagatggattcatctatacatgagcatataatgtgttcccatttgtttttgtcatctctgatttccttgagaagtgttttgtaattctcattgtagagatcttttacctccctggttagctgtattcctaggtattttattcttttttgtggctgttgtgaataagatcatgttctagatttgactgtcagcttggatgttattgatgtatagaaatgctattgatttttgtacattgattttgtatcatgaaactctgctgaagttgtttatcagatctaggagcttttgggcaaagtctatggggttttctaggtatagaatcatattgtctgcaaacagagatagttggacttatgctcttcctatttgggtgtcttttctttctttctcattcctgattgctctagctgggacttccagtactatgttgaatagaagtggtgaggctggacatccttgtcttgttctgcttctcaaggggaattcttccagcttttgcattttcagtacgatgttggctgtgggtttgtcataagtggctcttattattttaaaatatgttttcacagtgtctggtttgttgtttttttaaaatgttgaattttattgaaagccttttctgaatctattgagatgatcatgtagttttttagttctgcttatgtgataaataacatttattgatttgcctatgttgaaccaaacttgcatcccaggggtaaaacctactttatcatgatgaattagttttttgatgtgctgctgggtttggtttgccagtattttgttgacgatttttgcatctattttcttcaaggagagtggcctgaggttttccttttttgttgtgcctcttcctgtttgtttggtcagaatgatgcttgcctcgcagaatgagttagagacaagtcccttctcctcagcttttaggaaaagtttcagtaggaatggtgccagctctttaacacatctggtagaatttggctgtgaattcatctggtcctgggctttgtctggttgataggctttttattattgattcaatttcagaactcattcttggtctgttcaggtattcagtttctttctggttcattcttaggagattgtacatttccagaaatgtatccatttcttctaggttttatagtatgtgtgcatagaggtattcatagtagtctctgaggttttttttaatatttctgtggggtcagtggtaacgtcccctttgccatttctggttgtgtttatttagatcttcttttttttctttattagtctagctagcagtctgtcaatcttatttgttctttcaaaaaaacctcctggatttatcttttgtatggttttcccatcttaatttcatttagtttagctctgattttgtttttttcttgtcttctgctagctttggggttggctggctcttgtttttcttgttcctctagttgagatgttaggttgttaatttgagacctttctaaagttttgatgtgggcatttagcactatgaatatttttcttaagttggaactgctttagctgtattccagagattctggtatggtatatctttgttctcgttagttcaaagaaaattttcaaagaattttttaccttgattttgttgtttaacaaaagtcattcattcaggagcaggttgtttaacttccatgtaattgtatggttttatgtaatcttcttagtattgattcttatttgattgcactggggtatgagagtgtggttggtaacatatatttttttgaatttgatgatgatattttaatgtcaattttgtggttgattttagagtgccatgtgtagatgagaaaaatgtatatactgttgtttttgggtggagtgttctgtaggtctctattatgcccatttggtcaagtgtctagctcaggtcccaaacatatttgttagttttctgcctcaacgatctgtctaatactgtcagtggcatgttgaagtctcctactattgttgtatggtaatctaagtctcttttaggtctctaagaacttgttttatgaatctgggtgcttctatgttgggtgcatatatattcaggttaggtcttcttgttgaattcaacccttagccattatataatgcccttctttgtattttttgattgttgttggtttaaagtctactttgtctgaaattaatatcaactcctgatttgttttccatttgcttggtagatttttctacatccctttactttgagactatgggtgtcactgcatgtgagatgggtctcttgaagatagcatatagttgggttttacttctttatccaacttgccgctctgtgccttttaattggaacatttagcctgtttacattcaattttgatatgtgtagatttaatcctggctttgtgtcactagctagttgttatgcagacttgattgtatagtggctttatagtgtcaatattctacacatttgtgtgttcctgtggtggcccataatggtctttcctttccatatttagcattcccttaaggacctcttataaggcaggtctggaagtaacaaattcccttagcatttacttgtctaaaaagattcttatgtttcctttgcttatgaagcttagtttggcaggatatcaaattcttggttagaatttcctgtctttaagaatgctgaatataggcccccaatctcttctgggctagggttcttgctgacagagccactgttagcctgatggggttctctttgtaggtgacctgccccttctctctagcttactttaacatttgtttctttcatttcaaccttggagaatcagatgactatttgtcttggggatggtcatcttgtatagtatctcacagaggttctctgtatttctcaaatttgaatgttggcctaacaaggttggagaaattttcatgaaccatatcttcaagtatattttccaagttccttgccttctcgctctctctttcagggatgccagtaagtagcagattttatttctttacgtaattctatatcccttggtggttttgttcatttttttctttatttttgtctaagttattttggaaaagcagtgttcgagctctgcaattctttcctcagcttggtcaattctgctgttaatacttgcaattgtattataaaattctcgaagtcatttttcagctctatcagatcaatttgattatttcttaaaatattcattttgtctttcagctcctgaatcattttgttatattccttagattccttggattgggtctcaactttctcctgtatctcaatgatctttattcttatccatattctgaatttaatgtctgtcatttcggccatttcagcctggttaaaaaccactgctggagaaccagtgcagttgtttggagctaagaagacatcttggctttttgatttgccagagttcttatcctggttctttcttatctgtatgggctgatgttcctttttatatttgatgttactgtcctttggatggatttcattgcttttttttccctttgatgcctgtgggtgtttgattgcggtataaagtgggttcagtcaactggcttcatttctggaatattttagggggcaaaggctcagcttagtatttctgggctgtatgctctaactctgggggcctggtacccagcccccagctttgttctctggtcccttgaggttagaaagctgctgtacaagaggggctgaggtattccctagccacaatactccaatagggggtgccagccaaagtgttttgttggggcagtggccatgggatctgtgctcactcacacatgccagcaactgcagcagcatcatggggtacacgtgttggctaaagaaaggtaccagtgggagtagggtgtcagtgttcctgcatgtacttgcactggcagtggtggtggtgtggcagggatggggtactagtctgaattttttaatttaaaggactctcagtctggagctgagattgcgccactgcactctagtctgggtgacagagtgagactccatctcaaaagaaaacattaggtacaccatggtaattttaataatgatgacaatgttgttgttgatgatagcagcagctaacatttattgattcctcattagaaatcattaggaacagattcaccctctcattttgtcctcacaacaatcttacaaagctaagttataaagttagtataagataatgttaccaagagtttaaaataaagtggagaaatggaaaaagcaagacagaaaattttatcttttataagggaaaacaacttactgaaaaacctggaaagaaatacagtatagtactaatagctgctggttctcaaaggtaaaactatgtgtagtttttcctttcatcttttctgtcttatttttctcttataagcccttgttacaaggggaaaatacaagaaaatgtatttaaaataaacagacgatgtgcaatttcatttctggagatgactaggcaatgttttttctcaaaggatcttttggggcctcgagaaaacctaggttagattttgctattcatcaggtaaaaatgtatttcctaccattctctgttggaggcaccatagcagaattcagcaaaagagaaacatggttatagattgctcagagatagaaagatgtctctgatgagtgataatgtaaagaaataagtcacctcaggtgtcatgatgatttatgcttttctcagtaaatttaattttatctttttttccccatttgtgccttacaagagccctgagagactaggacaccaggcattatcaatgcccatgttacagaaaatgaggggcagtgagcatagttacctgccaaggccacacaatgagctagtaaaaacctgaacacagaacacaatcttaactcttaactcagtgctttcttccatgacaacagcttatctgggagccctgattcctcttggcaggaaagacaagcctatcaatatatcagctatctaagatatttatggatgaagattctgtgtaatgtctgctgtaaattcagtttactacaactctcagcaaaatcaaaggaataccagttgtatcccaccttttactctgccattcatgcaacactcattgattgcatgcagagaactatgaaagtgttaggcattcagtgatgcttgtcttcgggtagcttatagtggggaagcagttaatcaaatctagaagtataacacaatggaatcagtaacgtgaaggagacataatgaagtgtcgtggctctcagaagagggacacgctgctcatcattcattgactcattcattcaacaaataaaaactgccttcttgttgccatgctttgtgttgaattccggggatgcacagttaatacagacacatgatatttatcctcaaggattatcatctagtgggaaacttaagattgaccaaatgattatacagacgtacattaaatcagaagtgataaatatggcaaaggatagttagtggtgtaagaagcatgtgatctagggtgagtttcttctgattcaagggtgagtttctttacagccctctactagaacatgagaaattttgtatttcctccaaggcttggctattcaaaggagagtttgcaggtgctgattggaagtggcttacttaatattgcttatatcctttattgtaataatctgataggctatttcttaccacactgccgcttccttttcctccttcacagccctgcatatagtagatggtaatcttcctgttctcagtttatatatggagtgtaatgttggactgttcctctttgcccaatgagccaggcaaacactaatggagagaaaactgcaatcatatccacagtgttcatagtaaaacattagatcccaacctgaagcatcctctgctgagggtagcagatggcatcagggtgcctatgttagaagtaatgcaaacctgattatactctttctaattttttcccctcctacatgaagcatgctgtagccacctcacagaatatggtgatgtgtcaaaacttaattagccaacacttgtaccccatctacattatgtcaaaaactacactttcaagaacaagagaagagagctccaaaatattctggcaggcagagaattcttagaacacaaagaaagagaataaggtagtaagctattttctattatcaaggccttaattctttcttggataatcagaaatgggagaaaattttctgggttccctggatgtaccagggttgccatatcttctatacaaaaatggaaaaatctatgacctgacatgtatgtgggaaacgtatggtctggtgtgcatgtatgtgggactagaagcaggcatgtttgaagtaaatacagtttctgtttatctggtatgcatcacagggtgaccaacccaccctgtttgctcaggatggaggggctttctaggatgcaagaatttcagtgttaaaactgagaaagccccaggcaatctgagataacccttgatgtatgtaatgtatggctcttaaaaaaaaaaaactcttattatattcttagaaggtcatgttgaccagtacagtgctgtcgcctttgttctctcctttgaccaatgtggaggaatgaggctgcctgcttacaggaatatcagagatctttctaattcctaaactggctcatctatccaaacccctcacccctctcccaccatttttcttttcctcaggcccagctccttgcctcttaatggtcatgctcacagctttggggctgaatactcaattagccactgcagcgcaagaagagtcccccagcttcatccatcctttatccatgaagaaggcccagagctccttttatatttgctagggatttttcaccagagtatagaaaaaaagtcacgtgatacacttttaagtcataaaaaggacaaaaaactcacaataaaaatatgcatttggaaatcttatatgcataaggagcaagttctagctcagtttgtttatatattaagttcatgcccaagagggtcaatgccttctctaatctatccctaagcccctttacctctattatttgcaggcttggtgagggagcctctatcctacgctgcttctgcttctcatgcctatcggaggcaatgcatgtaatacaaaccctatggaattgggacctctccagcttgttcagagctggttgaagctccttgctctgccactttttagttcagtatacttagatgaattatttaatcctctaaatctcagttcacttgttacattttcacagagacctagaaacattaaaaaatactatttacatgttcccaacctcctaaggtggctgcttcgtttgctctcacattcagcacgatagataattgtaaggcatacaagaatttcaaccatcaaaggtgtaagtaaattctctatattctcttcatgatgacaaaataagcagttgaatatttgccctaagattggaaatcaaaaagtttatccatcagtgctccataaattgcagttgacgcttccctgtggcactaagacagctgtcaaggtggaaaatggggcttaggcttggagataggagtctttgcgcaaaaggtttgcactgcctcaggtggagttaattctccctgacctcataggcccattgtaaagattaattgagaagtgatctaaaagtgtatgacacacagagtaagctcttgactgttggttaagttgggcacacttcttttctcctgttggcacaaggcatagaagtgccacatgctagtaagtggaatttctatcattttctggctctcctccttacctgcttagagtttatggcccatcatccctatcagtcctttttttttttttttttttttttttacaactctaccctttgctgctgtctttcatcaaacaaactcacctgtcattccttatagctggttggacctagctctctgccttctctgttcttatccccaggctatttaatgaatctggataaagatatacagttatcatttcatctgtaaccataaatctcaagtgtgtttcaccattctcccacattactctagtcaactcacgctcccacattcagggctagctattttattatctgccttccccatcacccaaatttccaattcccgctcctcactctcagttgatgaccttgattctcatttgagaatataaagcagggctactttatcctcccacaaccaaacctacttccccagctgtacccacacagaaaccctcctctgtccctccagttatgggggtaagctgtcccttcacctgctggtggccagcacctcctttcttggataggatcctacattatcttgcgtggaggaggacttgacacctacagagactctgtctttccttagcatcaccagtgaattggattattcccatcagtacaagtatatcctaatatgtcctggattaaaatatatccttattttgatccctatttctctctagctagcctacccccattttgtgctcccttttatgtcaaaaaatttttaaatagttttttatactgtcttcgctatctcattctatattcatttatcaaccttccaagcaggtttttccccccggtattccactgaaactgctcccatcaatgatttctgtcttgctaaatcaaatgatcagctaattgctctctccaggaaaaaactttgttcttcttttggcttttatggcaccacactttctggatgtccctcctttctcaccggatgtgccatctcggtctccattgctggtgccttccctgcctgccaatctctaaacgtcaggataccatagcactcaattcttagccctcttttctaactacattcactccctggatagtctaatgtatgcccatggctttaaatatttgttatatgccatggaccaacaaatttatatcttcagccccactttcttagtttccagacatgtattttgcctatttgacatttctatttgcatgtttaaaaggcacctcaaactcagtaactccagattagaattcctgatctcccatccctgccaaagtccactccttcctcagtcttctctatctcaatatatcaaagggccattcactcaatgactactctccttctctcacaaccaatgtccaatccatctgcatgtcctgcttgccctacgtttgaaacagatattgcactacatcacttatctgcaccttgcatcaaccatgtcttatgtctcttccagatgacacagtggtttcctagtgttttgtttccatccttaccttgtacagtcagcttcacacagcacacagcagttggagtgatctttcaataacctgtaccaagtctttccaatatctattgaaagctttctagtggttccctgtaacatcagcattaaaaccaaactcctttccatagcctatgtggctcttgacaatcagacttttgaccatttttctgtaacctgaattcgccctctgctcactgtcctctgttcatagtgaccttcttcctgtttatggaatgtgccaagtctgtaccacctgatggtctttgagcagctgttctctttggctcaataatcaacttcctgctgttcacttgcttactccacttaggttggctcaaatgttggccatttgaggaagaggaaggaagaggttggctcctcttccttcagtggggccttcccggctgccccatctaaaatagcaaccctggccttttttcattctgttttatttattaacttaccacattaaaaatattttacatatatatgtatatatgtgtgtatatatatctacgtactttattggtttaatatctgttcctgaccagatccctcttcgaggctgaaggacttattcccccaactgctgggagttctcagtggccatctctttcccaggattgtctttagctgataagagcccctgtgcaagatcgcacctcattcccagtgagcccacagtcaatgactgacctatacacctgtctaaagatgagggttccctcgccacaatgggggaccattttgaagggtcatcccagtttcagagctttccacgaggtcagcttcagcctttgttgagcctgcttcacggtccattccttctttcttccttttccccgcaggacttaagcccaagagccctttccaatgaacttcctgtgcacaatgtccatgtcagaggatgtttcctggggaacctgatctgtaaaaccttcatgaaaacataaggttcaccagtgcttagacctcatctgtctaattttcagttatcttcccagagcctaaaacagtgcctggcacatagcaggtgttcaataaatagtgagtaaatgaatgaataaagtagaagggctgggatcagacccagtcctgtgtgatctcaaaggcactgtgttctctgacccacaaacactaccatccaggcaattccaacttacaattagaaattcagttccatttgaaattctgcccttgcttctgcatgcacctggtaccagatgaaacttgcagttagttaaggcacacagattaattgaaagaactcattcccacaaatggtgaccctgggagagctcatgcatggcagtgtaattactttggtcatattgacacatcaggagagcccagagtcaggctcagcctgaggtttccatctgaactttgcatttccgtaggcctctctcccttgaagtcaaatgacataattttaacaaattttgagtgtgtgaataatttcttcttttcttctgccctggtatgtatactgatattaaagactagaatatttatcatgttggcagttcctgcctgctagatttgattttgttaagaagccgagttttcctctgacagcattcaactccacatcttcttattcttgacttccactttagacactttggtattagctagctctacaccaaaataaaatgggagggagccaataggaatagctaagtatactgaccacattcattcctgactactggggaaacacaaatccagttactaaataaaaagccagttcagataaggaatgatgctatatcttccaaatgactcctgtcgcattcactggattaaaacccagagcgtcaccacttatattccagtgatgtatttagtaccctactttaccaaatcactaggaaagccatggactgtaacatctgtccaaatgcagagagaatcaaactctgattatgctaatctgatatcgacacaaagacattagtaaaataggccactctcactgaataaaatgtccttggctttcataactgattttttgacgtcatctggttttctgcaaaagccagagatagagctgcttacatttcagggaagactgtacctccagtgaaaacatgctccagcgcacatgatatttcaaagcagccgtgctatctttccatagccactataaatgtgcaggcacttcctcgtcacaggtgagatagaaggtgaaaggtgtactgagatatctctttcctagcctctgttaaagacaaaaaaactcattttttccagctaaagcaataccaaagatgactggatgtcatccctggttctgtagaattacactgaagggggagctcagagttctttggaactggaggtcaggcttgcagaattagtcactatttatctgaagaccgagaatccagcttgttaccatgatttcaaggaactgaaagccacacaagtcaggtgaaattcagaggtaaatgctacaaatttgaaaaggggaagctcagtgtcctctgctcttttttcgagctattttgagacatgggaagacactaaagaaacatggcaagtattagaaataaaaagcaatcctttataagaacaaaattacagtgttgagatgaaacggaacctgtcaatttccaatcatctattcagaggacaaagaccccatttcagggaatcttctacagatgttcttttgatagctttttatttaatagtcaactggaggctcagctttttataatttagtttcccagaaaaagcatcctattctcttagatcatttagtacctctgagatttgcagtattcactcttccgcaatatttgcatctcatcgatgttaactgcagaaagtaacaagaatgtcgagaaagactcctttcttcaacagcctgcctgccatcccataaccaccttctctattttcactgcactggctcttttaaactactgcaagttcttccactctgtaattggaaaaatttttcgcttcaattttaaaaattatagacatgtaataaaatgttgccctgcactgcttgcttaatctatctgctcctcctcttatcgtcatcgtttcttttcacatcctggtgactgaagctgtttaaaccagatgcaccatgagaagcagggtaataggaatgaataacagaaggggaggctcatgtccttttgtgggttcatcctggaaggtggggggaggagaggcttagagaggggcatggtgagagggcagcattagagacaatgtactcaatcccccttgatcctgcccttaagctctttcagaaaacttaatctccaaagatttagtttaattttgattataaacaaaatatccttctaccaatggtaactgataacaacgaaagagcagggaaacacaccagctgatgtccctcttctgaatcagctgttcctgatggtgcacagcttcacttaattgttttgttcttccttctaccctgcctcattccacaagagttgttatggcttacaggataagaaaaacatattgtatctaacattacgtttaacaacaaaaacaacaacaaaaatcgaagcagattaaagacaaattcagatagaatggcaggatctagagtaattcaccagtttataaagttcctctaactttattacaagtgaaaatttggttctgaaggccttgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaaaatggaagtctagttggtctataattaggcactaatcatctgatatgatggagatacctctgcagaatctgtagaattttgaattatctacttgtcattttctggggaacatcatagaagtgataatgaaatcactcaaatttctggatattcttcaacctagcttggccatcctagtccaaaaaaatataataagcatttatcaagcaccgacaaacaatttcagtgcatattaattgggcacctactatgtgccaaataatttgcagcctcagagataagcaaacagaccattagacatggttaaatgtatgacaaattataattacatgagcaattactttagtaattcatgtaaattactacacttcatgaagactaacaagtacagatatcacattctataaagcccacaaatctagcacctatttcaccatgttatatgtagcaccgttacctcttttgtggactaagtagtatagcaaacttgatggaataaataacaccgacttcaaatcacaagggtattacatgagtagcctctactgacataatttcaagggtcagctatttctctgtaaaattaaaattaaattctgaaaacactatgtgctaggcacagtaatgggagcattccaataagctgtaatccttaccaccattttaaaatattagctccagtctacaagtcaggaaggaggctcaaggaggtaaagtaacttgcttagggacccctggagtccaagtgcattccttgttttcatgcatcctgccaacttcatagtttatttactgtgctccatatggtgcagtcactaccaagcaaatggcaatgaaaaagaaaaaaagaaaaaaacttgcctgccatttctcttcttcatagctagtgaaagagtttactaacatcagtgtcaatgatcataaagctaaaacgtcctaagccttaaatttgcttttcaaataccagtatttcagaggcagattacctgactccaataatatgcctcaaaccttgcactgtgtgtgcaatgaaagggaatattttcatccattataagaggctgtcagaggaaaacattttcctgatatcatacccaagagaacagcatgtgaagcaacactatcatattctaccgaactttcatatactccatgcagtacaatgtatattttatcttttgaaaagccttggtaacaaaaggataaaatatccatctaaaactcaaagtacattctaataatgctgcattcacattaatagcattcaaagaatctcatagccttctgcaggcagttcacttgtctgtgctaagaatctatccttcagttacaggaggaaaagctcaacccagtggctttgcccactctttatagctggggaagaggcagaagctaaggggcagtgtggaaggcatccattaactaagtcttcctcctgaatggcaggctagtgggaggaatttctttcccgtgcacagggagttaagtcggagctgaatttgcatatctctttagaatcacaagggtattgattctagcctctaagacatttacataaaggtttcaggacactctcaggaaatagcaaaggaaactttggaactgagagtgagaatccccagaaaagcaggggggaggaaatgcaccaatttttggcagttgaagaactgaaggcagggtgagtctaaagacatatatgcctaggagagacatctttgtgttggtgactcagtctctgagtctcacctggtgcagttcactcaaatggtatcctagcaagtcttcagggatcctgttttaaattgtttgtctgagatttttgtgaaatttgggaaagccatgccatcttctgggaaactcgaaagaagactaaagtcccttcaaggtcagacctttcaggcttgggaacaatttatttgctttggagaaataccactgtcatgatgggagtagctgtgtcatgtttcagcagtgcttgcaagagtggagtgttagagaagtccgaatgaccgcacctccccaagcaccagcctccaaggaaacatatgtctcccaggactgtgcagaagggatgaccctgggaggctggggtaagctggcagcaacagtgtttggtggggatgctgagccaaataccattgcaatcaaagcctttgatcatcctcttgttggtgtgacttgggaactgagggtcacccttgaattcctttcagtcttaacactgaactaggagaagcacaaatcttaaatttccatctattaccattattattatccacagagaactgagggcagcctgagaaatgaatggcagagatgtgtcagctttgcccctgttaaattatgcacatcatatgaaatgacttaaaggatgactgcctaggagaaacagagacaggccatttacactggccagtcctttgaggctcatgactttaaaagttattcctgatccactctgagccctgaggaacttggaaatgtgcctattacggtttccaaagtgcaatcatgcttttggggtgaacaccccagctgcaaaaacagtaaggtctgtcctcatttcacagtaagagacagagccaggaagagaggctgcagaggagacagagagagcaccattgccattttttacagagaaaaagcatacatatcgtgacctagaaattaaaactatgtgttttcccctgactctatggctgccagaactgcttcagtgatgacaactatcttgggcattttatgtgccatttttttgatggaacgtgtaaaaaaattaactacccattcagaaatgaaattcactatgtgatttgccaccttgccagggaagagagcaatggtcagataacaaaacagacatgtaacaccactcctaaggataaaatacgtatagtgctagagccaaaacaaacaggctgcagagatgcaattaataggctgaaatatggtggtatcagagcacccaccatccctcatgctctcaaaacatggcaaagagaaggaaattggctgaaggtcagggctcttctgacccatgctgccttcttcctaagcccttgatatagatggaatgtatttctcccctgtcttcagtttcagtgcaatgttctgtaaaggaaaccagttttggagtcagacaacctaagattgaaactcagctctgtttcttgtcatctctgtaactctgggtaaattatttaacaactgcacatttcagtttcctggtttgtaaaactggccatctgaggtcatttggggaactaaatgagataaaatatgtatgtataaatggcagtagtaagtactcaatatatttagttcctttcccttttttcatctatatgtaattccaggatctggggtattttagaattcatctatttattatttcattcaataaacatttattgactgctttctgtatattacatactttgctgctaaccagatgctgacacagccataaaaattagtgggccaaaaggaacccagactgtagattgaaaggggtcatctttatgcacatcttatgcctcatatctgttgatgtctcaagcatcctacagggatgttacaccatccacgtaggaaataccagatctcacggtaatcggcaaggacaatttgttcgtcaaaacagattttgttgctcccacttgaatgcctcctttagaagtctctgttattaattcacctctgaaaggtgatcaacaaactcttacattcttccctttggttaatagattgattccgatctattaaaagtcaaattaaagttctcaccaagtgtgtaatcctgggagtttgtgtaacattcagctttcccatgtcttcacaattcttttaattttatatttctaatcacagaggccaacaacacagaacagtttgactatattaataaaattacttatttatatattatctgtgaccacttcctttcccccattacattcctccaagtggataacttacagttattaactttcaggaggcccctatatatcatagcatcataccattaagccttttggaaattcatcacaaatcagtatacagatgacattgatgtcttattgctattcattcctcccgggccgtttttagcagttcattttttatatccctgcagtgcagaaatatggctcactccagtatctgtcctttttgtaatcgcaaaaggaaagcttggcagttgtcatatattacactcttgaggaaaatgctagtaatacgtcgaattgattgaacagcatggacccaaactgcttggcatagggctatttcctcactgctattaagattttggttaaaaaaaaaaaaaccttaccttttagattcagaaactgtgaatcattaaaaggcaatttgtagaataaagatcacatacttgaagaagcctaaaagctcccctctatttcctctctttagattttgaacgtatttccagcatgcattcacattgttgcatgctacgctgctggaaacagtgtcattggccagaagctggttgccacctgggttgtgaaatagcccaggacttcccaggctctggaggggtagaagcttaaactggtaaagaagttgagaacattgtgactgcaaaggcattaggcaaaagccatacctatatgccatccttatcattgcaaaggtgccactagaaggactatggtcttggaggaggcaagcaaagaaagaagattgatatggtttggctttgtccccacccaaatctcacctggaattgtagctcccacaattcccatgtgtcatgagacggatctggtgggaggtaattgaatcacgggaatgggtctttcccatggtattcttgtgagagtaagtttcatgagatctgatggttttataaaagggagtttccctgcacaaattctcttgtctgctgccgtgtgagacatgcctttgaccttccaccatgattgtgaggcctccccagccatgtggaactgtaggtccattgaacctcttttcccttataaattacccagccttgggtatatctttatcagcagtatgaaagcagactaatacaaagttgtattaaaagaggaattaagatgaaagtaagaaaagtcatagctccatataatcaagcctatgctctcccctgcccctcatctttggaatgaggtagtgccaactgggcctgggggacctgaaatacagggcacaggcagttccgttggaatcattcttcaggaggccaaaccatggccaccggagtcctttccgatatgaatatttgtaactaatctgaggctttctttccaacaccagctacaatagttggtgatccacctgggtttactttttaaggccactagacatgtcccccagtttctattaattttgactgcaatcaactcacctttcttctgggaattgcccttgacctctaagaacagtggtgtgctgtgtgctgataaatctctatcatccagctctccagataaaaaagggggcttatatgtagcatttgcagatttctgtggtgttaacacccctaccatggtggatttcaagtcaccaccttgatggcacccaatgtggaggtgggaatagatacacatgatgggctctgaaaggcaggataagccagctccttaaggataccactgtacaggagacaccttgcctgggaataccagggaagagatgtgcctttcagaaggtactgaaggctgcctccctagaccctaggagtgcatggcaggatgagagcactttggtgttattcacgcttaggaggtccctgtgtatgttaagctgttcttgcattgttatacagaaatagccaaggctgggtaatttataacgaaaagaggtttaagtggcttacagttctgtaggctatataagcatggcactggcatctgcttagcttctggggaagcctcggggagtttttactcatggcagaaaaagtgtcagcagacaagtcacatggcaaaagcaggaacaagagccagtaaggaagaagatgccacacatttttaaacaactggacctagtgagaactcactcacgagtacagcaccaagaggatggcactcaaccattcatgggaaatccacccccatggtccaattacctcctgccaggccctaccttcaatattggggattataattcaacatgagatttggagggcacaatatcccaactatattactgtgggatcaggctatggttggactccagttaaactatcatctttgctgaacttctccccaggcctacttcccccattccctggcagctttcacgtgagaaacttcttcagaaaattatttgcataagaattctcatctcaagctctaaacctatgcttagacagcatcagactctggaagggtgacacaacacttattttgaacagataattttgtgaaactcttattctatttgaatttgacaagctcagaataaatgacgtgagagtcaacaaacactgaattgatttctgtattcaaacctacctagcaacgatgcattaaatagcaacatactaagtataatgtgtattcattttctccatcatagtgcaagtaatgcattttgcttatactgagaatagtgaaaatagctacttggcttaaaaggaagcaagagtggcttttccttaacttaaaaaaaatagtttctgaatatttcagaggaaaatgcaaattgagaaaaatctctgctccttagatgagatgtgaaaaatattcttgataggaaggtggcagaaaatatttttaggcagatgagatgctgctagtttgataggtttctattagatataacgtaccaaactgtgtgcgtgtatacattttcacccactggtaaaaatgaaatcatgtaccttcatcttatgatattgtatgtaaatgtttcatgtgggttagagcatgcatgtttcagagctaagggccagaatggactaacatcctatcaagtgttacatctgatgaagatctgagtaaaaacacaacactaatctgttcagaacatcaggtgggcaaagataacattaacaaaataaaactctcgccttactgaatagacactgggtttgctctatgagaaaaacagatattaggctgaatggcttattttcacattatttgcagtttggattttggccctagcatactacagagcaaggaactaaaacatctaactttttaaaacgttaagaatatgagatactggaaagagatggattattttagttattcttaatctttcgtgcaacattaataaagttgtatctatatgacattaaatcttcatcagaaaaattaagtctgggagctgctcagatgttcaactgcctacgctgcatagactcctcaaattgcattatttattccagtttttcagttttaatttggttcttttgtttcagaaaccaagcttagaagaaaatgagcattttcttaagtccttcaaaaagaatctactatatttcttttcttttctgaggtagtagatatattattatttatttttattttaattttccaaccaaagatacctggtttataggcaataatatccctttaataggattcaaagtgtctgaggtttacatagaacaactttgtgggtttattcaaatggtcaggcttacaaggagtagatcgaccaatttcagagccttcttggagagaatgtacaactgataccagctttttaagatcagcatcaaaagcttatcttgggtgtgtgtgactgtttctgccgctgtccaggagatctaccagtcttacctttttaactaatgtaaaaccatttgtctcaggctgcttgacaggtggagctagtctgtaaaacttagctcatgtttttttcttttctctcccatgtttagatggatggtaagagagctgagctgcaagcagtattatgtgaataacacattttgttgcctatgtttaagaggctggttgttttgtaaaatgcctgttagttgttctctttgtttgattgttcgtttgtttttgagatggagtctcactttgtcgcccaggttggagtgcagtggcacgatctctgctcactgcaacctccacctccctggttcaagcaattctcctgcctcagcctcccgagtagctgggactacaggtgcgcaccaccacacctggctaatttttgtaattttttagtagagacggggtttcaccatattggccaggctggtcttgaactcctgaccccatgatctgcctgccttggcctgctaaagtgctgggattacaggcgtgagccactgctcctggccaaatgcctgttagttttatctgtgggattatgtaaccagaaaactaaagtggtatgatgtgatggctactgaactcatgagattcctggaaaacattctctcttgtaggaattcatctgcctataaattaattaaacatctcaagctagtccttctataatttttaataaaaattatactcagttctgggataacttgaattttctctcatttaagtaccgtcactaaaattgtacaactgtcaatctttctgtgtttagttaaaatgttccatgaaagtggagaaccaatttcactcatacagaaaagagaaggcacatgttccttggtcatatgtatacagaaccaggagaaaagaggaagtgaaaggacagggaaagaaggacagggaaagagacacagggaaatgatgaaagggagggaggaggttggagataaagactggagagaaaagaaaaggctaagagagtaaaagagatgaaaaaatgagaaaaaatgagaagaagtatagagaaataaaggaacatgatgcaggaaagaagagtaaagtcctttctaatacccacaggaggagtaaagaatgagagagaattagagacacttatgaaatactaaagccaacaaccaggtgtttccttgggagatttgcctaatgactctgcattgattttctggatgatgtcaagaggtaaacattacaaagaactgccaagacagtgagcggcaatcctcagccaagatctaaactcagcaatggtgcatgagaacctgatacccacaacagaatgcttctgcactgaatccatttcccaacttaaaatacagcatcttagactttcacattttgcttatctttcatcacttttcactgctatgcactgaaatcttccgctccctgcaaaaagctctgctctgagtataaacacaactaccttgatctcattttaaaatctgtaatcaaaatcctcttttataacattcattttgctctgaatccttcattccagctactcagagtacaatataccaaaggagagagcctgtatccaaaactttgaggaataattttgatagtggttaataagaggacaatgcaagtttcttccaatgttagtgctttaaagggtgttttcctttaggaggatttacatcctagttaaatcttcattccaggatggctgcaagcaaatatattccacacgtcccatctaaccactgctcatacagaatcaaagtacatcaaggttggaaggggattcacaggtcaagtcaaagctctcatctgatgcctcattgtgttctacaatttcaagtacccctcagtgcccatcagaactctttctgtgccacgggtctccatgaaacagaaggtcattcaattttcacatagcttgaattcttattttgaattgaagtctggccaaagttactttcaaacagcagagctagttctcccctatgtctgagcctgcacagaaaaggtacatttaaaatcagctgtaatgacttcttaaaatattttcctttccaatagatgcatagacagagaaaactgaatataaaacattttgatttttcattactttcttcctcttcttctgtactttactgtgtcaatgtgttttctattagttaaccttactgtcagcactaggggaactgatgctaacattccagatactgtcttctcagtgaagggtattgcatgacaatggcctcacttgtcatggatgtagaacctcaggtactgtgtaattagactgaattcatctcttggcatttcccctgtgctatttactcaactgagcatattattcattaacttcctgtactttttcacatgtagtgttcttacagaatatgttgctcggcctgaatctgtgacattttatgtaaatatagtttgagaggaaagttttatctttatgccttttgggtttggggtactagcgaggtggctctgaattcttcttctgtcttccatagagttgaaatcacttcacctctctctacatatgctatgaattctaatgcaaacattagtttctctgacaaagaaattcaactgggagttatgttttcttgctgaaaacaaaaacacctgtgatggtagctaacagcatgttcttctctgccagtcattggcttgataacttgcattattacctgcctactaagtgcattttttcatataattctctccaccaccaccctgcaaggaaggtagaatgatgatgctccttttacaaatgaggaaactgaagcttagagaagttaagccaaataaaccctttgtttagtaatcaaagataatcttggttcattttgaatcaaccagcaccttctcacatttatctacgatagtgctggctagacagtagcaatctaaaattcaaactcagttctcacatctggtcatccatggccatgtattctctcccaaatggaggtatacattgtcttgcttatcctgctttcctctaaccacaactttttaaagtgctcctcattttctggaaacttcaacttgtcctgggcttgattctctgtgaaaccattgacaaatgatttctcctctggtcctccttggctctaagccctttctcctgcatctctacatgccatttaacaatattatttctcataaaattccccgtgctgccacttcgatatctttagctcctgccagttcctttttcggtactatcgtttgtgattctatcaccataatcttatttttaagagcttcccaatccactagagccatcttccatgaagcaatgagatcacatcaattttaatcatgatattttaaaaatctgccttttgaagttttcatatccatgtctgacaatgcctagctttttttctttttttaaccttgctaccattatttctaagataacacacctactttttcctagagttactgtccactccacatcactaagcctttccttgttggttagaattaaataaccagacccctatcactttctcctggaaaggatataattgatatgtcaataaaggaatttgtctaaccacaaaatacagatgagtaagaattgcatccacttcttcagcagctcttaaagatctgctgtatcccacaaacatacataaaattatacataccattttcatatcagagtttcagtgtaaaaagacctttggtgcttaaagacagctattgagttttaaatgggtaaggatacttatccaggaaaatttaacatcagttatccaataaaaaccagcaccacggcaacacatttagatgacaaaattgatcgacctttttgttttctttccaccttctgcatatagagtaagatcatctgacatttaagatcctcctgcaagttacatttctttctatctcccttttcatgctagctcatatcctacctcttccataaagtcttgtttgacaaacccaacttctcactctattaaaacattaatgccaagatgattgatttgctaattaatcatttcttaatatctataccgctattatctcaaatagttatttaaatcagttactgccatttagcttctgtgtgtctatattttctccccaaatatatcgtaaattttttgaaggaacataaaagcctcaaacataagaggtttcagaacatagcaatgtggacatgccgtgaatggcaatgattaaattttgcaatcaggttcagaggaaaattttaaaatagagaagtgataagattttaaataccaaaccaattcacatttcttattttttcaacttattttaatagtcataaaaaacataactgaaaattagttttagtaacagattctgtggatagcaaagttcttttccccatgggccttctcacattccccccaccttggatcgtagcaacttttggtgaattccacctaaacgcatttcttggtaagcaagggtactcttggttccattcaaatcagtcagcgctgtcatggataaccccaaggatataaaatgaaaatatgaaagcatgtttatcataaggagctcttaatctaagggctaatatctatagtatatttgtcttactattccttacaaggaaagcgatattaatattacaggccaaggttcagatcctaaaataaatataagtaaggtgcttaagaagccaaataaagagagatttcacagttagctaaagagatcaagaggaatttaagagatagtattggagccacagaggttaaaagcaggggttcggactccttaggcaagtggggtgaagggtatattgtggccaaagcacagatcccaggaaaaggagagatgcattcactttgtttgttttgtttgtttgttttttaaagtttacactctcactgggaacaaaaggtatgtacgaagtataatgcaaatgtctgtggaaaggagatttggtgctgtattacaagggctgtgaatgccaggctgaagcatttatacctgatttataagcaattaagagttttattagctcgtatttatttcatgggaaatgtggaaacttccatgtagatacacctatagctttgtgttggatgtcttccgatcgtccatttggatccatctttaccttgcttaggggcttggaggctggcttgcatggactgattcaacaagctcctttggcttctgccttctttccataagaggggaggaaaggagtgcagtcagagccttgttccccagctccacccttaggggttgccctgagctggttgcttccctcactgaaggtcaggtgttcctctccatggttggttcatttggtctccaggttctggtcctcactccctctcctcaccccttccagacctggggtggttataaacggtccctctatgagggatcctcatgactcaacatgttccatgtctcttgctgagactctccctgatataatccccaggtatccagaaatcaaaaggaaattggcgacaacagtagttttagcctttgctgggcaaaatttcaaacaaaaaacctgaagatatggggaaaaatcagcttctttgagataaccaatgtaggtcttcagtctgctgatggccagcttcttctcttttttgcttctctctctttctctgtctctctttttaaagatggggtcttattatgttgctcaggctggtcttgaactcctggcttcaagtgatcctcttgctttaagccttctggggagctgggattgcaggtgcaagccactgcaccctgcttctttttacttcttatattcctgactgtgccattaggctaaggtcaattatttctacaacctatctccttctcagaggtttcaagatcttctaccctctgtatcaggaacaggttgtattccaaaaacttgtactggatgtctgtgaaagtctgccaattcattagggaaatgtaaatcaaaatcacagtgagagatcacttcacaaccattaggatggctatttcaaaataaataacaaaaaaaaaaaaacaacaagtttctgtgaggatatggaaagattggaatccttgtgtgttgctgatgagaatgtaaaatagtatagccactgtgtaaaaaagtgtgacaaacctcaaaaagttaaacatagatatgccccagtaattccactccttgccatacacccagaaaaactggaagcagggactcaaacagttcattgtataccaattttcattgcagccttattcacaataatcaaaagctggatgcaacccaaatgtctatcgacagaagaacagacaaacaaaatgtggtatatacatacaatggagtattattcagccttaaaaatgaattaaattttgatacatgctccaacatggatggaccttgaaaacattatgctcagtgaaataagccagacataaaaaagataaatattatgtaattctacttatatgaggtacctagagcaggcaaattcatagaaacagaacgtaggacagaggttaccaggggctgagggggatggaaaatggggagttcttgtttactgggtacagagtttcaagttgggatgataaaaaagttacaaaaatgcatagttgtgatgactgcacaatagcctgaatgtactcaatgtcactgaaccatccactttaaaatggttaaagaaaaaatggctgtcaaatattctgcagcagagaccaaacacaggacccatatgaagaactatcggtagttaagaactcctagaaatgacaagatgatactgagagtggagaggaacttagaccccacagcattggactggaagtgtcaggagctggcttccaaaggtgctctcacaaatctaagctgctatgaatctgtgattagattcatttttattgtttccctgttgtacaggaaaaaggctgtttctgactataattttacaaaaatgccaaaaagttttaaaaataatttgttgatttgtggttagtaaaccagtataatctttatgttcacatctattattttagattccttttggcactgcaacaaattaccccataattagtggctcaagtgaactcaaatttattatcttatatttggggagttagaaatctgaaatcagttttgctgggctaaaattaaagtgtcagtagggctgtattccttctggaagctccaaggaagaatctgtttctttgcgctttgcagcttccagaggcctccttggctcatggccctgtgtcactccgacctctgcttccatcctcacgtctctgttctgattcggactctcctgcttctgtcttttccttttaaggactctatggttacaaggggtttgcctggatagtccagggtaaccttccagttttaaaatcctatatttaatcatatcttcaagataccttctgctatgtaaagtgacacatttagaagtcctgtggattaagatgtggacatttttggaaggggacattattctgtctaccacatttatcaactccaaatatattttcaaatgaaatggaaagagaggttagaacatacgtatttttcagattaccaaattaatgcaagtctgttttagcaaatctagaaactttagaaaagaaaaaataaaacagtattatccttcatcccagtctcttttttagatcctaccttctatacttaacatatgataaggatttgtcgtgtcatcaactaccttttatacttagatcctacttcttatacttaacatatgatcctaccttttatacttaatatatgataattatgtttagatcctaccttttatacctaacatatgacagatcctactttttatacttaacatatgataagcaattgtcatgtccttaactactgaggtgtctattttattaaatgagttaaaagatgagaaaagatgacggaactgagttttggttaaaatgatagaatcggcaagtgggttttagtctcagttttaatatgttttttctccttttagatattttagatcagcagataggtttctatgtgccatatttccttcctgaaagctaaactcacgacctttcaatacccacctatatcaaatcctcaaagcaaatatctatattccaaaataattgattgaagttatccatattttactctgcggtaaccttctcatcctgtatttcattttcaaattaccaagaatctcacttatgtgactatacactaaaattaaaacacaaacacactgcgtacactcactttggtctgagcaaaaagacatgaaaggtgaacatttttgtgaaattttacaagttcaatggctaacaagggtctcaatctttaaaacagtcagtgaggcttaactcagtgtaaaacatcatttatatcataatcaaacttcttcatatatggaaactttaagcaacctgaaaccacaaagaattatctccccaacctcctctttttgattaagttaatttagtagctttaactagaatggattaattagctccaaacaatgtagcaattggatgttaaatttaacagggtcaaagggtggagattggttccaaggtaggagtcttatatctacatacaacccagccttaagggcgtgccatttgtaaaaatacaattacagatttaatattcattatgcaaaatgtttgggatcataagtgcttcaaattttactaattttggatacttgcatatatctaatgagatttattggggatgggatccaagtcgaaacaaaaaattcatgtatgtttcatatacattatgtcttatgtagatagcctgaaggtaattatatacaatattttaaataactttttgcatgaaacacagtttgaactgcattttgactgcaacctgtcacatgaggctaaaaggtgaaataaatctcatttttaaataaaaatgaatattttctattacactcaaggcacagtgcataggatgagaaggaataactattattccttgctattcttgtactgaggttgaattttagccttaaactatggtaaggaaagcccttgttccttcatttgagcccaatgtcaggtcaaatatgttaaaataaacatagtaacgcaagtcaggggcttccagagagctgcatcacagttttgtgcataagatacacttgaacaccagaaagaataatgcttgtggataaaaatgcgacacaaaacatgtagttactaggctgcatttcacgtactgacacccagcttggctcagacttcaaaatgtgacatcttgcccaaattcaacaaaacttcccagtcttacagggtgattttcaaatcgattaagttgggtatttctttaagggaaaacaaaaatcagagcagtgatttgaattctcactttcaaaacaagtttccaactcattaaacatcaccttcaaaatgtgatacaaacatgatttacctattgcctagcaaattaaggcatttcattaccaattagtttatcacgaccaactatattttattttctacctttcacaaatgcaaaaggaaccatcagacagttctcagctcttcaaaccactgacaacaaaaattgtgccagatataaatatttacatcatgaaaagtaaatgttgccaagattccaaactccaatgcatttgaaaattggtttggatcaggtatactttcctgaattggaaagatacaaaatcatctgttcaaaaaatatctctaaaacaaaaaaaaacccaagtcataacatgtgagtgatttttaacactagactatctcccaatctcttctttcccaataaattttagggagaagctgtgttgacatttttttctttcacatcaacatttttcctttaagacattctgatggaaagtaaaaattatatatccattgtttgtgttagtttgacacattttccatctcaatcccaatctgtactttatctaaaaccccttcaaatgcttgccataactcgtaggcgaaggattcagctcccgaacactgcctcaggacctgccctctgctgtcctctctagcctaccatcttgcaagcctctcttcgctccctgtgttcagccttgctggctacctttcagctgcattctggaactcaggcaccaaaccccattctgtatcttgggcttttccaccccctgcttttccttttgcctagaatgcaattatcccctacatcaccctctccaagaaagaaagaatgactgaatatttaatcataactacaacttttccttcttaaatactgaccagcgaactcacacgtgttcacgactttaaataaataattcacctttttaaagagaaatgtacttagaagccatgacaagctccttgcagaatttataaaaataaaactataaatggaacaataattaggatagcatcgttttatatggaatcagagcaataaactaaatgacctatatatgacctttccacaaaaatgcttctcaagtcatatttaaaacagtacacaaatactgcataactaaatggtgtcgaccacatgcaatgtcttttaaaacctgctttgtgacctgagtcaaagtcacttacagctttttgatgagtcattaggggtgtgtgtatctgtgacagttacatggtacaagaaaatatatttcaatacatcagaaggggaaaaagttaacttacaaacttcatggtatttatggtgaacagactgcacaaaggaagagagaacagagcccaatgacccaaaccctgaagaatcagccgctggtattatcaaaagttgtcaataattttaacctcaattttttgcacacaaattattttccatttctcttaacaatagctaaattacctttgaacacaattttctgcatgtgcattttttttttacctttaacaacctactcaacagtaaaagatagccaagtagacatgaaccagcaagagaagtgctaagattccagtgatgagaagacccaatgggcacttgtgcccttccacaaattaaagaggagctcgttatggggggaggagagtgaaggagggatttaggtgtgagaatcacaaagcccagctcagcatttctgtgcaggagctaggattcttagcaagcaagatgcccctaggaagattaattattgattttcttataaatcatctaaggtgatttttgtctgtttttttcctcccaagatgatgaacgtctgattttatttttgttaattggttttctcacttcactgaggttaaaagaaggcctagtaaagcagtttcttagaggaaagattttcccagcatgataggcaggggtggccactatgctttctgtcctttatgggggtaccaaggttgtctgataagacttcaggcaacctccaggaggtacagagtaatcagaagcacaaaagtttgactagttagggagaaaaagcacaatttagacatatttctatctaatggcggcaggtctgaagtctgtggtattcctaggtgggaggacaaactcatcacagagactgaagccttgaggattagctttcagaatcaagatggccccatcttcaactttaccatggaagcaatatggtggcttaccttcctgccccccgtgttgatgcgaagaggtgtcagaaaggggtcgaagatcatgtgactggtctctatgttgactggcgactgccgtttccccacagagcaaagattccaagctgagttcaccaatccccagaaagaaggaactagaaacaaaaagaaattatagaattaggctgagtagcaggttggggaaacaacataaataaacagagctatgtacaaacgtggtaaaatggaagagaaccaccaaatgttcccacccatggagatccttgggggttgctatggtattttcctggtctgaatcttggtccacttctctaagtcttacctgcatggtctcttgtcatcagattttcttgtttgaggcccactcatcctgcagtttctttgttgactgcagtcatcattaacactttaatgctaacatcattgttcaggtctcatcatctttgcaatatgcctggggtagcacaaatatttagcaattccctggagttgatgctgtgcttttcctatctggcaagaacgatgtgaaaatcaaccttatcctatttggaagtttttcaaggaaagtgtcattcagtgtacacaaagtttttctttgggttgtcaagactaaactgagggagtgacttattttatgagccccctaatcaatgccagacaagagcttagcaacttgacttcatctttgtttagttcaacactgtgtcattaacctaatgtacttgtagataaagaattggtgttcatttgataggcagaaaaatgacattaagagctgagcacaaatacccaaaggaaaccgtccactcattttcagtgtcacatgaaaacttctattagaatgtatttctgtggcaatttccagttcgatttctctctatttaagaaagttttcagggcaagggtggggagccaacctactaattttatatcagtgaagatcaaaactatactttcagcctttccctgcccctttcagtacttccatcgagtctctggatccatgtgtccttcagattcccctgagattatatggccattcattcatccacccatagtacatgcagtgaactcctatttggcatcacgcactgggttaggctgaatctcgaggaaggcaggtaagcacaagaacaactaacacactggggaggctcactagtgtgaggtcgagtatgttatgagactccggatgaggggaagccaatcctgccatggtagaggggaggcagggagtgactcctggagaagatgagcctaacaatcacattagccttcttaaatggacctgtcctctcagaaactcaagtttaattaaacttaaattgaataaaggctttaacttacagtagccatcattcttgcctatagcatagatggagaaaactaaggcaaaagaggagtttggagacacttgccaaagatactcaaattctttgactctcttatttgttataggcaactgtaacagacatgggaggagaactaaaaataagttccttggcctagacaaacacttcaacatcaaaataagatgggtctcattttaaaatatgacaaatatctaatttggtttcatccatgccaataagcctctggtagaccatttcctttagtttaaggagtttgaattggctttttagtcattaatgactttcaaaatggtagcaatggcctgagttacagagggagaaagaggaggaggaggaagaggagaaacattgacacatgtgcatgggcttcctcggccctctcatttcttatcatttcttaaaatatgttatcactacaagttactccacctttagaaggtaccacgtcctagcaagactacaatatttaagaaagttcttgcattatgaatgcacttatattataaatataaacttgtcttttctaaactacttttttttaaaaaaaacactgacttgatcttatatttatttatccctcaatcatctcaaattatgaaaataaagccttcattagggcatcctcctagcagtctttgtccgtaacgcacacacaagtggcaaatgtgagcatgccagggatatagtcatggcacctccacaagtgaactgagtggcccttggtaagtcatgtgtcccttggaccttcttcatggttcctgtggtaggccgaatggctctccaccaatgatgtttactatcctaatcctcagaacatgtgaatatgctatcttagatggtaaagggtattttgcagatgtaattaagttaatcgttttgggatggagagattatctaggattatctgggtgggcccaatgtaatcacagaagtctttataagagaaatgtaggagggtcagagatataaagatatacagatggaaacagaggtcagccaggagagaagataatactctgctggctttgaagatggaggaaggggacatgaaccaaggaatgcaggtggcctctagaagctggaagaggcaagacaatggattctccacctagagcttcctgctgtaaggaatataggcctgctgataccatgatgtttaaccccttgagaatatatttgacctccagaaacgtaggataataaatttctgctgttttaagccatgcagttgtgatcatttgttatggcagtaacggaaaagtaatacagcacccctttacctttaaaactctgtgagacaataacctctttgacaatgaagacatctatgatgcttgcagggctctccctagaaggcagctgcatgattaaagtagttacagctggtgcacattgcatttcatctactcccatgaaaagcattaacaaaaataattccaagcccataaatggattataagactgctattatgtggcaacatgggtgggcagctgctgctgtacttcactaataaacgtcatgcccaaaaagtacccccgcaaaaacacaaacaggaaaaactttatgcgaacatctgccttctcttttattgggcatggaattctttatgacgaacagtttcggggttttatatccccacttcacgatcaaagcctgcgtctctgatgctaatcacctgctcagccaatcgaggaagaagtgagaaacctctctcctgctcagctgtgtccctcattggctccagccctgaactgctatctaagtttatttacccctggatggctgattttaaatcagctatgaattaatagcttttcagaaatagaagccaccttagagatcgtctgacttaaattcattacatggatttaaggccatagaggcagggagtaaagtcctccactctaggtcacacagccaggtagaggcgaggaaggacagagtaaagaacattactcaagatttccagtgctactgagcctctgctgctctaaaccccttcctctccagcaggctctatacatgagcagatcattttaggaaatttcagttaattgctgccaagacccctgtaagacttttgctatcatttctcttttggtaaatcaagaataacattagtgccaattttccagttaaaataaatttcaagtgcaaaggtttgaatcaaactgctttgaaagtcaactattctaaataaacttaggattttaaaggagccatacaaccatggagtaacatacatagaagggcctgggtgtgaaaagacttcagttcaggcgatgtgtttgggtcccatctgcaggcctctgaggagacctgatggggatgattgcacacaaagagctgctccagggatagttcctggggtcagctgcaccgggcaaggttttagtgcagataaaaatgagaagtcagtgctgttaggagcggtgttaagtgttgggacaataattaagatattgaagctagtctagggaactcaagtgccgaatggaccagactaggtctgcaaatgtggtgtaatctagattctagggaaatggtttaggacgaaggctgtgaaaacaggcgtccatgaagtgcctgtgcctactggggcatgggagtcagatggcccactttacatgcagagcaaggatgggcgtatgaatgaaagcttcaagatttagagtgagaaacttgccctgtgggtttgtgcagaactgtcagttatatccaaggttctgatacttaactacccttcatctacccttcatagtgttatctttcaggtttatagacacccgtgtcaccttttggagcaaaagtgggttatataatgctgtggcaggcactgcctctatttccaaggtaagagaaatattgttgaatttttttctcttagtttccatggctatcctccaaaatcagatgtttaaacttttatttttaaagcatccattattatggcttattagctaatgctgtgtctttacttgatcaatacaacttactgttgagagaaaatgtaaataaagcaaaatagagtaagaatcactctaattaatggacaaccagtctgacgatgtttgaattccatcatccttggcatcctttttgtacaatcttctaatttacatataaactagaacacaaaacagacccaaatatttttgcaaattaattttcacacagcctaaaccatggaacttaactgctgcatcacagcgatgtgttatcttgccaaagtatttcccaatggcactactgccattcttaccataaattacaaatcccaaacgttctcttggctctgggtccagtgagttttgaaagatgctcagtgactctgtgatttcaactgcttaaatcatgagccttggcaaacccaaagcaaaacttatcagctgcttgttcagacccatgaaataaaaaagctccagctgtttaataacacaccttggcaacgtctggacaaaaacaacaaagttttcaccaaaaacaaataggtcagaagagcaaggaaccagaggaatcaagtccgataaggagagttaaaactggccttgacttctttgtcctagagaaggtgttccgaagttagattgtgcttttaggcatcttccttattcatttgtcctaagccagcagaatttgctgctgtgggcaggatattaggcacttggaataagtttatacagcttatgtgaatttgctaagtcctatggcaacaagataaattcaattcaaaagcatttactgacagcctctgatgtgccaggcattagggttggcactgaaagttgatgcaacaaatctttactgaggacctactatgtgtcaggcactgccatcagttctgggaagtcaattatgaatgagagatatggttcctattctcatgaatcttgcaggctagtgggaaatatgggagataaacaagtttctatatgtctatctgtgtaaagtttttggtaagcatgttgtagagacaagacggtaatggatcatagcttaaagcatgtatgggagagaaaacctaggtagcatggtcaagggtggtctctctggaagggtcagctggtagactctggaaggactgggaaagttgcttctaaacagtggcaggagaaaggatgtccaaggcagagcgaaagtgagcagtcttggcagagaagagctggatgtgttcaggaacagagaggaagtcagtcgacttgagcctgatggaccagatgaggagaagagcgaaatgagatgggggctggctgggtagaccaggaacagatggctcagtgctctgcaggccacactaaggagtttgcattttactccaagttaatagaaagccactgagagtttagcagggaaataccatggtctgattttttaattaaaggcaggtatctgcctcagatggaacacagccaagagcaagctcgactatccttgaagtagtttgaatgggaaaagaattggttcccaagcaacagttggggacataggtttttaagtgaatttaatcctattgcttttggtgtgtttaaattctatttcaaaggcagaactaattgaatgttttaaaattattctcttcaaaatatgtgccaataaaatcgtgttttcctaggaactagtgctttacaagccattctttgaagcaaggaatattttcatgaagacactcagctaaagcaatcttttctcgttttcaagcaataaactaagtcccctactttttggtcaagggaaagcaaatgaaagttgggaaaatgaacgctggcataaaacatatctctagtgaattcaatcctacagataaagccttccacttcaatatagcaatctctactttggggttataaagcatatgaatacattttaaataagaactcatatctttcccttgctcttttcctcaccaatcctgatttactgtctcttcctctcttctcaactgtaataaatctccactttgagccattattaatgagcaagtttaaaatacccactgctgcaggcttttggtctgtttctgatttgatttatttcatagatggaattggccttaaagttaacccctttgctgatgatttcttcctccattgcagggcctctgactcatagcacatggagggtctttaactagggctgcccattgttaaaggtaagttctcccattgagaactagggctgtcacttgggaacctctaaggaattgcatatatcctatttaacccataatcattaatttgtgcattcatctaaaaaattaatggactgtatctgatgaaccagggatagaaagataaatcaaaatgctcccactcttcaggacactcagtatggtgggaagatagacaagctaacaaatagttataacaaaatatgatagatgttataataagggtatgtgtatattaaggcttaaattaattcagagcaagaagcaagctgacctggcccttttctcaagtgctaaggtaagccttactcatagagagtgcattattttaatcctattgctttaggtgtgtttttagtcttgtaactagttaaaacattgaatcatctcctcaaacagagatatactagtcctaacaactaagatggattatcaccggaatgccaactattatacagggaaaatttaagccactgcatcttccatcttctcacttctccaatatttctcccatacagctattattccatggggaaaagatcattagtaccatgtccttaccacagaaccatcagaaggtggctaaattactaggtggcttcatttctctagctgtaaaaatgggggtgacagctacttcacagagctgttgggaagattgtgagaatgtatttataaatggtctagcataatgttggctctataataaggatttaaaacattggagaaggggttgagtgaggagggggaacagcatgaaccacagtgtgattccaacactgtagcattctcagggcagaaacagtcgagggtgaaggatccaggcagaagggtacagggaggcaactttcagatgcccacccaacccagcctggtttcagaacagggcactctgatgggagtctaggtcaagggattaattgcttaattccatactttcaatgagccatgtgcatttatttcttggatccataggtctcaatgtctggataaatgaaggcagtgagcagtgatatgggtcatccaatagggtttttaactccaaagaaaaatcattttaatgtagcttttgggagttgtcagattacttatttgtgcagcagcagcttcgtccttcttcctgtttgtacttggttccaagtggtgactggctggatccccaaaagcacatcactaaaggtaaagagaaaggaggaagagggaattctcttttgctgatcaccccctgtttaacaagctctgtgctaggaacttgacacatcttatcttgctcaatcctcctcattattattattttacaggtgaggaaaataatactcaaagaggttaaatgactttctaaggtcacctggccagtaggttagggaactagaatttgagatcagtttctttctttaaaacaaacaaagaaaaaaaccaaaggaagtaatgtatgtatggtaacaggtcaaatgatccacaggtgtataaagcaagaggtaatcatctcttcctccttccagtaacatcctgaggaaaccagtgtgaaagtgtattaggcatcattcaacatctttcagtatactcctacaaacatacatacaaatatatacacatgtatatatatatttgagaggttcttttctaaaaaagaagtatttttataaaaagtaacattatgccatggatgtccctccatgtccatactaatagagcttctctttcttgtgtaaagctacagaacttctacagtttgaatgcacttcacttttctcaatcattccctagatgaaagacattacagttatttccatcttactttaccatgaaaatcaatgctgcaataaatagcctcagagatattctttttcatactggtgctttcatttcagtagaaaagattcctaaaggtagtattgttcagtcaaggtaggcacatgctttattttaatagatgctgtcaaattagtttcaaagatactggtagtgactatgatgaacatttactctcctatcggcaatgtgtgatgcatccatttccccaaaatctccatagtattggatgttatttattatttatttttagcaatctacaggaagaaatggtatctcactgattgaatttgcattttctagctactagaaatatttctagtatattctcatatgctcattgattatttgcatttctcttctgatcgtattcttcacatatttttctctgggttatttatgtttttcatttcaacttcagctgtcatgtgaattatggagatattaaccttttgtgacatggtataaatattttcttatagcctcttatctagcttttaaaccttgtttttgatattttgctatataaggattttaccattttgtatggttggatttgttgataattttctttataaggtttctgggttttctctctcatttaagatggcctttccaactacaggttatatacgtgtttttcttacatttttataaaatatttttattgttatactttttacaacttgattatttaaaaatataccagtgattaatatttgtatatgctatgagacaggggtctaatattttttccctgataaaaagtgaataatgccagcattatttattaaacaaaccatctttcaccatcaaactgaacgcccctttgatcacagattaagtttccatatgtattggatttgcttctggtctttctagattgtttcacctatttgtgtattcttgtgtaagtgtcatactgttttgagtgtagtaacatttatggtaatttatacgacaaaacttccttcctgatcaaaaagatgctgctcttcccctgctaccactacgggaccgtaaacacccaagctccacggaaatctggagttaggactagtgatcctaggaacccttaagctgttggaccattcttgggggcacaagactgtcagaggttatctggctcctcctcatgtcttcaggtagttaggtacttcagtcatacttgatagaggacagtgtctgcccctttcctcaaaaagccctcaaggggaaatttgctcttttaatcaccttggaagtagactttattatcgccctgattctcaccagtcttaatggaatctgagacatagagacgtcaaactaacttgttcaagataaacaaaaaaaaaaaaaacaccctggcaagtggtgaggtcaaaattcaaaactcaggttgttctggctccagattccttgtgttcttataactcctgtgctatacttcctccctaacctggtgccctgacttaagccaaacatgttttcttctgagcctcagtctcctcctttgtaaaatcagggtcataagaggacacactttgctgaatatctttgtccaccaaagtgatagtgaaaaatcaaaacaataaaattagcaatgatcatcatagccaattctttttattcaccaagtcatggagtatgccattggtgggaaatcagaaagaaggtagatttacatcaaattctacataattgcagtccccaaagatgggtactagttttcccattttacagataggaaactgaggctcaaagagttgagtaatttatccaaggttattcagccagtgcacagctgagctggtgatttgaacccaggtctaaaattcccactcttattctgctctcattcatccctcagacctagcacagaattaagatgaattaagctgccattatggtttcctcctcaatattttgctttctgagaattaagcctcctgaatcaggtgactcattcttgcgagaatccacaggaaggcataaaagacagtctggttgacgtaggcattaagctcttgtgtgcctgtatcaggtttaagatttagtctaacagttgtattaagcattatcaggttacatttggctagcaatttttcttgccccatgtaattacaggtgcttcagataaaatctgaaattagttgatagaaactgggaattaaaaccacaaagagaggaatgtctcaatgcatgtcaataaaccagcccattaattatttctacctactcaactctgaagaaaacgaccaggctgatgcctctggataatcacatgacctacttgatgtttatacaaaagctgaatcttcttggctttcagaagcaaataccagtaatgttgaaaccagcagggacacaagaattaaatgccagaaaaaaataatatgaccactgaaaataggtgatcttcttcagcctttgtaaattctgaaagttcaccaaaacagtatcaggtgatgatttcccacaaattcaaacatctggtgaagcacttctaaaatcctgcaaaacatctggatatcatggaatacatatgtatgtatgtatatgtttagtatgtaaacatctcactgtccctctatccctttaacactcactctctctgtacgtacatgcaaaattatacccttacacacatggcaaaagtaggtgaataatgaagggtacagtagaattgcaaaccctaccacatattaataactgtatatggagatcagttgaacttagccttacagcccattgcagcagtggatacctcagtttttgcaatttctcattgtcttcacatttgtgtaattctatagaaacctccagctgttccagtctgtcttgaggtttatgtgtatgtagggtattttctttattatttacacaaataacagggcttagttatcttcatgagacatcaggagaaataatcttcatgctgccactgagtcttggaacccaaacacaacacaactggtcaccaaagatggaacgaaaccacatatataatccgttggtgttttaatgattttgcactaggattcattgtccaataaatgtgcaatgtattttttatcgaggtgctagattttgcttctatgatatagtgtcttgaccaacacatttcacttgtcctcttaactttcctgttagacttttgtataattacacttcctattagccaggaaggaaatcttgcaggcattatatatatatatatatctgtcatctcccaaatcttaccatgatcaaatctgggtgatagctttgaatgctttgaatattgaacctagctactagtagcctaatgcaggttcccactgccaggtgccttagtttttactacagtatcttactaaagttcccttttacaaatgacatgagagcttggcagacaaggaagaaccaggactaaaaattgggctaggtccatggtccacaacagaatttagtgcacagcaatgtaaggatgatgttactctagacctgtgttcccttgcagccctggagttctgatttgatgctaccaccatgttgccagtttccattccaatacttgacacaatgtagatactcaacaactacttattgagtgggtggatggatgcatggatggatgcatgagagagggcaggaccaagtgtctgctttgcataccattttctctcccgtccttgtcatactatgatcttacaatataatttgtagaatgagtggagaattattctacttcatttcaatacccccaataacacaatatgctcatgcttacttttgtgcttttgctttaattattctttccactttctacaccccatagtcaaattctatacctcttagcacccctaatttaaatactaatccctccattaagtcatcctttactattgaaatcatcactctggatttctagagaagctggttaggtgctagaggattcctacttaattatgcatggctatattgttcattgtcttaaaaatgcatttcctaaatagatgcaagttcttcaagatcaggaactctgatatggcacaagacctaattacagggcctgggcctataaaaggtgactgaccaaaagtaaatatctctaaagggtttttaaagaaaatctcttgtattcaaaatgactctagcaggaaaatagatttagtgaatttctggcactcctcaacaccttgtacccaaatgtatgcccagcctttcggggctcctggcagttccaccaacaagcctttgcctgcagtggctgcactgcctggagcatccttccttactttcctatgcatggagtgcttgttgcaagcatgatctgggactcaaaccagagactctgattaaataagtctatggcgggatccagagatttgcattatttaacaagcagcccagctacttcccatgcaattgtccataggtcatgataataggagaaaccagctgatgaaattaacatttattggaagaaagcaggtttttctcagctttacaaggtcagcaacatgaccttaacaatgacaggcctaaagggaaaaacacatcgactaaagggtcaataagaaagtatggaacagagaaacaaacattcaaatgttgcctcctgccctgccccttgagagagttacagaacagtatctcctggtggggttagtaaaatttcactgggacccaccattgctctcaattttctccaccttttgttctaattcttcgtccaccaaacaacctttggatagaggttaccaagtgttctaatcccaagaaagaaaaagaatgtcttagatggcagacatgaatagttctgttatagaaaggggatttcccaattcccacattttaaaatgaacggtcataatggcttattcaccatcctgtgctattttaatgatcaccagtcaggcctaaggtccaaatcagtgaatataccaggactatcctgtttctggaattaagaatatgtttatcagacatggggccatgaagttttaaccggtatgtggcctccaacaggcactgccagcaaccagaccctgcccctcaatggcctacctctgcaggctaccctcaccttatgggaagagagtctgcaacttatcatcacgtaagaaacaataagctgcatttaaaaaccaaaaatgatttgtgcacaaagacattaacaagaacataatttatcataatgaaacactgaaaacaatctaaatgtgcaacaataataggggaacggtttagtaaattaggtatactcacataaagaatattggtgccatcattaacataaattttaacaatacagcaaatttttatatatagtctcaaatatataaaacaatgtgcactggagggacaaaaaaataaccaaaatgtggatagatgttatctctggatagtgaaattacaggtgaatattaacatacatgtatattccaagctatttacaatgaggaggtagtactttcagagttaaaacatttgaaaaataagactgcttatttgggccagattttaacactacagagaattatattctgttaaactgattaattttcttatcacatctcttttcattagcaaggaaatgataaagagactctacttctctgcacccactttccgaatttctgggtcaactgggatgatccgggtagacccaggaataacatgcaggtggtacaccctccccttgtaggaaaggagagaaagggcagtcacacttagcagttgtcagaaagaagacctgggagacttctctatatcaagcaagaattcctccttttcatccctgcccttggacaagagaagctaatagggatttagttaattggctggttttcatcctaattggctgatgaatccattccaatctcaagaaaaattgcagaggaagaaacaaatgagggctcagctgccaattgatgttttagagacggcattttatgtgtcatgaggtctgaggtcctggagctcagagtattagctttccgggagactggggctccatcaagggtggggtaaatatccttgctgggagaccacaggctttcctgtctcattgaagaaaaaccgaaaacgatggcacacattcgattttgtcatctaatgctaaattcagattaaatcaacacggactcgttctggggtagggacagaaaactccagggggctgaggctcttgcattatgtgggccttctgaaggtgccaggtaagccgatgtcagctgagtttgctcctacttttcccacatcagtcagttctaccacttaacagggggattagtaatctcatttcttgggactgtcatcaaagtatcagaataaaaccacttagtagagctagccttctgcaaaatgttgaggtgggctaaattggtcttccacaccttgtcacctgccttttaagcctccttcccctcgactcccttatcaggtaggctatttccatttctcactccctttcagtctagctctcctgctccccatgcaagattacacctctcacagtcacacagtctgaactgctcattggtacttacgatcagatataaacaaaaacacacttaggaaaggtgggaatgatgatagaaatttgtgctagctaagaaattcaggccagatgagggctatgaccaaaccatcctaaaaagatcacaggaaatcttgtcatttgggacaacatggatgaacctggggggcggcttattaactaagccaggccccgaaaacaaatactgcattatctcacttacacgtggattctaaaatagttgaactcacagaagcagagaacagaatggtagttaccagggctgggacaagaggagcaattggggagatgttagtcaaaggatataaaatttcagttaagtggaataagttccagaaatctattttattaacatggtaattacagttaaaaacaatgcattgtctacttggaaagtgctaagaacagattttaagtgttttcaccacaaaaaaataagtgtgtgaggtaagacgtatgttaattaacttgatttagtttaactacttcaatctactgatcagatgcttgtagtatctctggggattaagaacactcaatggctcctcattgccactggtgcactgaacctcctttagtctggctttgactgccctttgctgtctggcagcaatccatcccgtgggacctgttttctgtggctcctcatcttggcctctggctggatgagagtctgacatttccagtgtgtcctggtgctttcctttctccatcacaccatgtccctcacctggcatgcctactcattcaaatcttactcattttccaaggctggactcaagtattgcttcctttgaggattttcctcaatgctccttacattaagtgatactttcttcttcctctaaaattctgttttatccaatgtctctgccatttgtaacatgtcttataacaatagcagaaagcatgtttttgcgtcttaataatccttgtagcttatagtatgataatgaaatatacgttgtttgatgaatgaatgaggagtgaatttttaaggtatcctgggcataaattctgagtgaatgctaccacaccacacagctggacctttctcttattcttgtttacttgctctggctctcatatattcgcacatttctgtcagcacaattagggtatctaaattgaaaaataaaatattgataagcagagagaaaaacagtaaaaacaaaaatatgatgaatgcttccattgtctcagaaatgacagacctttttctacttggcctttataatgtaattatttaagtatttctgtatgtagaatccaccttgctctttagaggccctcaggcactttttacaatgcaacatcttgattttggaatgcatcttcatgtgcaaaaaaaaaaaaaaaaaaaaaaagccaaaaaccttgtctagactttgagtcacctttatttgtgtactgtaaaagaccggtaggagcagcccaaatggctacagtgaatgggagagcctcataaaatccgacaaaggttcacatacctgaggtttgtaaacacagcatatgttcttgtcagtgtagatgtgaccttgccggtctctttgcagactatattagtgctgtgcaaatatttctactcaattgtaaaggcacattatactcagggaaattattctcccagcaaacagacagatgtttagcttcactttaatatgacactataatctgaattcttaatgtgagacagaggtcctgttggagctagggtgaaactacacatgcaaagttttaacaatgcagcactttgtagcatagattaagtcactacctctttctgactaaaactttctgctctttctttcaagcccctcttgtagcaccatgtgcaggggccatggtgcacttagcacaccttgacaatcctgagatgatgcaggaggtggctgtgaggatatttatcagtctctctgagcactatcaaacacttctgcttgcaaagccctatagaataacatggagcaacatatgtccagttgtgaggttcccctcttaggagaatatgaaacatgcctatcctagagatatcagcaaggctcaaaaaattcaaggaaaaagaaaaagtagctggggatagaccaaacccacatatctagattcattcttgggggctttggcattcaacaaacagatccatcttcaacttgctagttgttgtcaaggttaattatcctttaggacttcaagtaaaggaggccaaggaaactgagctcaactcaagtttagacacagtgaaatttcttttactgctgggactcagcaacaagactgccacccctgtgaggttctctccattttcaatccacttttctacactccgcctgtattgctggggcaggggctcaataagccatatttctgctttgtcagctcattcctgcaggctctgcccataggaaatctagagagacactggaaggctggagctcttcctgtttgcctcctgttccggttggcattattccagcgatgggtcattgccctggcacttggttccactcttcagatttaccctcccatattcctagaacaagactcatcataaccccttggacacaccaacaccaaccagctgcaacgctccccagaggactgggttccagttctgcaagggcctcctccaagctccagagtcctcaacagcaggtggagaaagccctgctatgagtctccagttctgtgctctccgatgctcagcttctaaattcttttcccagtcccttctccttattctgccgtccctgaagtggtagttggttccttttattatgacttttttgtggtgcaccagggtcttttatgtgtgtgcctttccagccctctaatatccaattaaacaattattttatatgaaattatcacagttgagataattgcatggtttctattttcttcactgggccctaattgacataacttattacttgtaacagagttacacagatgtttgctaaattgctgatattatatatttttgaaggtatatttacatgctaaaaatgtatgattaatctgcatctattaaaaagaacatgatagatcactattactgtccagaaagatgtccataatatattgagtgataacagcagtgattttttattagtaagcatttgtttcatatataagaaaaataaataaaattatgaagaagttaaaaataacggatactatgatctctatgagaatactttgttattcctatttaaataactttgagaatatctttagcataagtaattggggcagcaggatttttcttctgcccaatatttagttgggattgcaataactatcaaacaattaagatgcaatttatgtctttgtcacaatttgaaacccaaaacatttatataatatgtgtaattcaaaggcacacatgctactgcatctaaaatttaactttttaactaaatataactaaaaccaactcacagaaaagtctacagctgggaagaagaattagtaaaaactttaattgtggtctcatttacacttctattttcaaactcattcatgaattaattttaactctgtgcctctgccttcaatcaagccataagtacctgtcagaaaatgacagtgtttgaatatctgcacatatgttggaaatttctacactttgattcctttgtcaaaatttccacttagagctgtgtgggtgaggctctaaggcacaggcaaggaggttagtctctcactgtggccaagattccacgccaaagaatgttcatttagcgtgtaagccaacgcagaactccttattaagacagttggccctcagagtcttataaagcaggaggggagtatgatgtatggaagcaaatgttgagcaggaactacagaaggttagccttaagggtgatgttccatagaggaaccttgggctaatcttaatctgtgaagatggacattggactatagagctttgtggcccctgtgcagcctgccattatacaagatcacttaactacaatgtcttaaagcaactcagtctaaggcagtagttgcaaaaattttggatagtatatccctgttggggaaaaaaatttgcgtgcaatgccaccatgtgaatatttattcataaattacatatggatgctgttatactaattattagtacaattaggaacaattagtattgggtaccctccaagacactgaatatcagccagcaccctctcattcagttgtagtcacactgaccttcttactgatcattagccttgctaaacatgccctgtctcaccatccctgcactggatgcctctctgtccactagccacttggttcatattctcacctacttcagggctgctcaaaggtcaatctcagaagggcttctctgacttcctgtgttacctctgaccctctgtctcctctttactctagaacacttgtgctgggttcctctgtttaccttgcagacactgctttccccttctctgtccttttctgtgccctgggaggctgatttgcatggattacattcaactgggctcccctgaattatggcttctctttgggtttggccaataggaggcactcgcagggaactggagggtgagaagagagatgcctggacgtttattccatcagcaaccacccttgcagggctatggatgggaaatggctgttttcctctcccaaggtcacacctcctattgggtgtccttctcctaccaccaatcactgcttcctcttcatttgggccaccgcttcttgccctggaggagatagttccctattattagaaggccctagacgacttcaccattccttgttagtttctcttaaactctgcctagctttctataaatagcttttcgtgcactctcctcagacatttactttgagcatgccatctgtttcttcccaagaccctgaatgatacagcacttatcaccaataaatatagcatatatttatattgatagtctgattcctcccatttgaatggaaaatagccgagcgcagagatttttcacctgttgttgttttctgctatgtgcttagctcctaggatagtgcacagcatttagtaggcacccaggtacctgccaaatacatagatgaataatattttcctcctaggtcccaatggattgtcttgcacattccattttggaaatcaccaacttaaggaacaaatatatattattcttcaccaggttttactaagtgttggactaacctagcttaattcctacataatacatatccctgattattttcaaagcacatgaaatgtaatgtagcaggaaactctcctgaaagttctcaggttcctcctccaagattctcataatgaaagctccaacagatattgagccaatcatgagaaggaccttattagttcaccttttcaagttgtctttaacagattttctttctccctcctgatttccgttttaagaacatttcttcttttctttcaataaggaccataaaaactgcccaaggaagcaaagccttggctcactcactttgtccctacttgcaacaggagaaaaatcatcaaaatcctgttccccggctcagttacttaatttgcatatgatgctccattacttaattatcttataactcttagggcttagttgcccaaatcagacttaacaatcatctttggtaacaacatcccttacagcaaagagctaactcaaaagaaaatgattttttaaaaaaatgacaaacacatacaaatacctttttgtcctccatgcaaaaatttgggtgatggattctttatgaattgctctatgcctattaaacatgcccattactttactattggaaaaaccagattatttttcacatgcctgagtttcctttctttgtactaatcaataactgcagatgtactctaagagttgctaccatactgaacaaaatctgatcttcaagacaacctcgtggaacctgctgaggttgccttgggagggagaacctaagtggtgagaaactgctgaatcctgtatccaggaggaaacattctgtacacacaataacttctatgtgcatgtggctacaatttttaatgctgtgctcatctctggctatatatagtggcatgagtaagagttttctcgtgtggttttgagtttcttgagctgtaaatcaaaacattgtgatgttcaaacagtctttgggaagaagagaaaattaactgccaaaattattaaaatggaactctactttctattagaaccagaatagaacagcttgcatgaataggtaagtgcaaagtaagatataattttctttcacttgaatggcgtttgtatttccctctgccagcagtggtatgactctccaatgttgtattactttgctaaagctgctataacaagtatcacacactgggtggtgaaacaacagaactttactgtctcacagttctggagagagttctcatttaacttgaataattatatttgcaacaaccctttttccaagtgaggttatattctgaggtaccgggggttaggactgcaacttgtacatttgggaaaggggatgtaactgcacactggctcatgctcagctatttgagaggctgaggtgggaagatcacttgagcccaggagttcaagcgttcaaggctgcaataagccagtatcatgccactgcattccagcctgggtgacagagagggaccctgtctcaaaaaaaaaaaattaaaactaaaagaagatcaataaatttgggggagcacaatttaaccacaacaaatggtaaaaataaaaaatgttaggtcttaagaaaatactaagaaacacttggtccagctcttttgttttttagtgataaatagaaagggaaaatgtcttatccagggttacctgtcagcaatagcaacatagactcagagcacgaggcacaaggctctgctctggtgctttccaaagcacacactgcctttatttcattcttcccaaagctgagactcacatgcatttgtggaggggaagtagcagcagtgactcatcctatatgaaaacccatccagagacttatgtgacatatctacagcaacttgctttgtggaggtcattcaaaataggagaattaaaaaaggactaggctggtcttgaactcctggcctcaagagatactcctgcctcagtctcctaaagtattagaattataggtgtgagtcactgcatgcagcctagattcaaagtcttatacaaactttcctcgtttaaatcactgtgtggtttgtctcctgattggactcagactgatgcagtctgttctagtaccagtttgtttttacattgaaatatttgctccatcaggagtttatcttggtataagctgtgagtatggatctagctttatttttcacagatggctatctggttgatccaaacatttattgaaaaacttttttcctaactcattttaaataccatctttattatatactcaattcccacatgtatttgggtttattccagactttaaattgtattccattacactctgtcttttccatctccactaccacattgtttgaatatctgtttaatatctgataggaatagtccctggatatttttgttttttttttttaatttgaactttgttatcagaatgtctagatttcctgctggaaattttattgggaattgcaatacgtttgtagattagggatatttgacatctgagtcttctcaagaactagccactttttattagttcaagtctcttttggtgtttctcaacagtattaaacattttttaattcacaaaaggagcactgtgtatatttatagtgtacaatatatttgatataaatataccaatagcattttaattcatataaatcttgcatattattacttttattcctaaatatttgatcattttggttattgtgatggcatcttttcttccattataactttttaacttgttgctcttagatatataaagggtacaaatatcaaacataaaaagggaaagcaaggtttcaaaactgaattacaaaacttcagtgccagacactgtacctggcaattgctcagtgctccaagaaagttaaaccaacaaataaaaccaattttaatagtgataagtattactctgttgtgattagagcttccaccataaagtattttcaagtccattatcatttgttttctgcaaactctgagagacaaacattattctcatttgacagaaaggaaaactgaggttcaaagataaatgactttttaaactaaagtgttacaatttgacagaaaggaaaactgaggttcaaagataagtgactttttaaactaaagtgttacaagccagtttgacaaagcttgtatgctattataatttcagattcaaattccaatgctccctctcctaaatttttattgttttgaggaaaattaaactaaacattaaaaaagttcatttacttccatttttatgcctcccttgaaatgcaaatttagcacaagccaaccatctctctctaagcatttccaagcacttgaggcatccacttctttgcactcagcagatggtcataaaatatgaacaaatgaagacagttcatctttagactctagggagtcacggagtcacataagcttaggatttgaatgggcttagaggatttctaaataatgctctctggtttataaataaaaaagctaaggcactacgtcctagagctagtaaaaaaaaccagatatcctcactcccaaaccagtgttctgatgcttgtaaaatctggcactggtttaatcagagagtgaccagctggaataaagtcctgatcagattgcttttattctgctttctctgaagccaagaaaggtcatcaaagatgcacaggagagactgcaaatgagtacaatactgtgcaacagtgatattcagaattattaaattggaagccctggtgccctttgcaggcacaaagcagctcctctgtaaggaaatgaaaagaggttgcgtgtcgagggatgaggcttctttctatagagaccccattacagctccagaggaaagaacatcagttccttccagggagtctgtgtaacagataatgtatgcttcttttcaggctgtcaagattcacaaaagagataggaagtttgaggctctattactggtgaccttcccacagaatacactgcatctcatttttaaaaatagcccggctcttgggtggagtatttgatggccttcataaaggaactgaaaactttgggagaagtactgaaaggaatagagtgaaaaagagaaagaagaaagcaagaggcaaaaaagaagagaaaaactggtttcctactgctccttcatctttctgcatctcgaagtggtcacctttttttatctcagagcctcattacctctgagaggtttcctgatggcctcaactcatctctaccatccttcagaatgctaaacaggttggactttgtcaccacccatagaaaccttggttatttccacattgtaaagtccgcattccttagcatagcaagccaggtgctttttggaaattcagcttccactccagcttcattttctgctccacttctccaggtaactcatgctttggccaccgtggcaacttgccactcctcaaacatgccactggctgcccactctcttgggcatgcttttacttttttcccctttctttcatcaatcaatattctccctaagaatcaagactcagatcagaggctcctgtttctgagaaaccttccagccaaaatgaatcactcccccacctaagctttttctctggtctcaaagccttctactctaagctctggttcttttgattagacctaaagacaaagccatttgtaaaccaataacagatctgataactttttggttctcacttataagtgggagttgaacaatgagaacacatggacagagggaggggaacctcacacaccggggcctatcagggggtagggggaaaggggagggagagcattaggacaaatacctaatgcatgcggggcttaaaacctagatgacggattgacggatgcagcaaaccaccatggcacgtgtatacctatgtaacaaacctgcacattctgcacatgtgtcccagaacttaaaataacaaaaaatctggactaattttagatttccaaaaatgttgcagagatagtatagacagttccccacctaataatttttagaagaaatattttatagaaaagcataaagaatgatattaaaaacacatgtatactcattttccatctttatcaaatctcaacattctgccatttgattcagatttttttttaaagatataaaacaatacttggttctccatgtaagtctccttgattctaaggagacttgattctaattcttcctactcagaattaagcactctcctgatttggcatttatggttaattggcctgcttttatatattcactacacatgtatgtatcccagaagttatatttgattgccttgtatgttgttgtacacatatgacctcattctatatatagatcagctgtacatattttgattttcactcaacaatacatttgtgatttttgcagatgtagttcacttattgaatgttctatatagtattttattgtgtggatacacaaaaataattgtcttcaacagatagaaattttagcttctcatttgttttttaatgtagagtaagagaaacatacaacagtgcacattgcagcactgcttgtattagcaaaaacaggaagtggatctggattgatccattaactatgaatcttacccatccttaaacatcatttaagcccttagggtagaaaagaaattatggggaaatcaaaatgatacatttggcagtggtgagaggcttcctgttccttttggttcagcaaaaaactttttattctttagacctacaaaaaagcagaggctttttttttgacccacacccaaagcagagggaaatcagtcagcatttttaagggaactacacatgctacaggggccctttagcgtctgccaagctcttcccagtctcaagaatggaggtaggagatgctgttcatgctattatacagaatggcagaattaagtccaaatggcacctggagtcttacctctttatatcctagttttctgtattcagtactggcccagattgcttttattttctgttgaaataataaactcttttacaaaaaatatgattgtttttcctcagttttaaaatatgcctataaatattctacaggaatagagggtaatagatgagctcaagtattttgcgagttaattaaagtagaacttggatttatttcgtaacgattttatacaaattgaaaggaaagtaagaaacgttattccaaggtgttcaaggcaggccttgtaccatctcacttcccactggttctactgaaacatttacatttatcactttttttccttctgtttattatgagagtatctaatttcataggcatggtggtagaacattggggtgaataagatgatgtctgctcttaagaagttacttgctactccctgaatatatgaaaactttttttttttttgtaaagagagagtgatggtatggttcactaaggaaggcaggagattgagtagttctggagagtcacataggaagcatgttccacatagagggtggatgcaagtgaaggccaagttgtaaccatctatcactgcctccaaggagcacctgcaatagcacatctacttggagtccaagtcctggttttcatagtttggccaattccatcactgcccaaaccatgaagtaagaaaaataatacaacttagttcaagagaataaaaacaaaatggagtgtgccacacaccagctatattcaactattttctgctctcctagagtgccatgcatttgcaagcctccaagcctttgcagatactcctgctttgaatgacattccctgtattctgtacttatccactgtgtaatgcaaccttaaagctaattttaagcattgtctttctaggaaacctttctcactccccccgagaggggtgaatcatccctcccttgtgtatattcccagagaaggctgtttctgcctctgtaaaatacagcactcagcacagtctgacaaatagtctcgtaaattgtgcatgcctctgtgtcctttactcttagaaggcagggactcatctaattcatctttgtcgtgccttcaatctgtggcacagtgctaacatatagtaagtgttcaatgtgaagttcattaaatgacgtatgtagctgcaaagaaaaaaacacgtagcattaggaattagagtagtcaacagatagtggtagtagaattgcctcaaattccatgtaagtatgattctactgaaaataactgagttttttttttttttttgataattggcattaattcccttggctctaccaagagatcttaggttcaattccctgggcaagcaagcaaattgtgtatgtttgagtgggtaagtgaggctattccacatgaatctcatttagaaattatgttcaaagcaggccatttgctactggattcattacctttcctagatagcacagggtgaaatgtttgcttttattaaagtaaataaatagctcataattgtgcctaggaagggaaacttaaaggcaagaagaaaaacactagacagggaatataaaagtgtattattttttcctcaatattgcggttcattatatttttgaaacagttgtgaatggcttttccttaagtaatatctgggctcttttctctagataatttacaggaaaagagaaatataccttagcaaggcaggctaaggaaaattattttaaaactcaaacatatcaggctaaaatattcatgatgtaaaaacaaagcaaacaaaacaaacagataagcaaaaacaaaacgagaagaaaacatgagaataccaatagaagaaaaatatgtaatttggtttggttccagctctggctgtgattaagcatataccatcctccattttccattgattacaaataaataaatataaggagtctatctgaaaattcagaaaagtaaataatgacaggtgaattggggaatgaaatgaaatggaaagtagtatcaatatggtattaagcttaaaggtattttcagttttcttcttaatcctccagcttggactctaggacagcccaaatcccagaactgcacatcaagcagagacaggaaatgcttcaagggaaacatatgtacctgtctgtattctagaaaagccccagtcacaaagccttagactagtgaaagcagcagctatgcatacacctcaaactctggaagacattctttttttttttttttttgagcagagaaactggaaaactaggttcctattgttctctctctcgctctctctctctgtgtgtgtgtgtgtgtgtgtgtgtgtgtgtgtgtgtgtgtgtgaatcgtcattaattttctctttccagtctctctctggttgttttgccctcaagggaagcaagtcatcatgggaagtgtgaaatagcatagggaacctaaagccctgccatttatgacagaagaccagagaaataagcccctggggactagagagtgaagagaaatcatggaggagaaagtggtagagaaaaagtacacctaattttgtgtatgaagtctcaggctcaccactaattggcgcatgcattgaaattaaccaaggcagcgtaacaactgctttgataattaaactatgatatagaacaaagctcaggttgacccctgggtggttggtatgtgtgtgtggagcagacaaactagctctacaaaggaattgaaaactaaactaacacagaagccagagtctaaatagagcaggttgaggttagacttatgacaagaaccatgggagactgattacctgctaagatgaaaaaaaaaaaaaaaaggaaagaaaagaaaagaaaaatcttctctagaggattttaacaggaccagagtctaatatataatactcaaatgaccataaggcaatcccaaattactaaaaataaaaaagagcatctcaaaagtcaatcaactgacatcaatccccaaggtgacccatgatgttgaaattattggacaaagattttaaaggagttattgtaactatcctctatgaaaagaaaaaaattcttttaaaatggatggaaagaaatgttgtaaaaaatagaaaatataaacacgaagtaaatattttaaaaataaaaaataactaaaaaataaactggatgaatgcaatagcagaatggagatgccagaaaaaaaagaagagtcattgaatttgaaaagtagatcaacagaaataatcctttataaataagagagaaaacacaaataaaaaaatatgagcagagcctcagggacctgtgggacatgtcttacatttgtgttactagaatcccagagggggcaggtaagagattggtgcagaaaaaaatagctaaaaacttctcaaatctgtggaaagccataaatttacagatttgggaggctgagaaacaccccccaccaccaaaaaaaaaatttcatgcaaattctcatacttaaaacactaaaatccaaagataaagaaaaaatattgaaaacaacaagtaaaacaaacactttacatatagaaaaaaataattcaaatgacaacgtattttagtgaaaatcatagaagccagaaagcagtattataatctatttgaagtattgacagtgaaccattaattctaaattctatattaaccaaaaacattcttcagaaaaaagtgaaataaagaccatctgatcatagcaaaattaaactagaaatcaaaaacagatatttaaaaacctctaaatattggaaaattaaataactcactttcaaataatcaaaatatgagagaggaagtcaaaagaaacattagaacatattctgaactaagtgaaaatgaaaataccacaagtgatggtcagttctgtattttcaacttggctaagaggtagtccttgttatttaatcaaacatgagtctaggtattcctgtgaggtattttgtagacatgattactgtataattattttgctttaagcaagaagattctgagttgaaaggcgttaagagcagaactgaggcttccctgaagcagaagaagacattctaactatagattgcagcttcagctccaacttatgcccaagagttccagtttctaatggcttgccctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttagagaaaaaagttgtacattaaatactgaaaagttacagcactaaatactgaattataagtgaaaaattcaaatcaataacctaggtttccatattaaaatattagaaaacaaaaaccaaattaagccaaaaccaagcaaagaaaaagagaaatgtcaaaggcaaaagaaaaaaaataaatgaaatttaaaatagaaaacaacagatagagtcaatgaaatcaaaaggtggtttgttgaaaaggtcaataaaatttgataaacttctaagaagactgaccaaagagagaagtagcaaattactattagacatgaaagaagacataatactacagacctcacaggcattaaaatgatattaagagaaaattatagacaactctattcccccacatttgacaactcagattaaatgaatcattttattgaaagataaaaactaccaaaactgacaagaaatgggaggtagtggtcacctggatcagcagtctgaggcactcaacccttactgtgcgtagattctggtgcagcgatgccctctctgctccgtgcccaagcagatctccgggcattcaaagcaccggctcacccggattgacagcctgagctgcctcacctttcctgcacagaaatcatggtgcatccaggccctctccacttcatgcccaagcagatctccaggcagtcaaagcaccaagtcacctcgatcagcagactgagccacccaactcctcctgtgcagagactgtggtgaagcagggccctctctgcccaatgcccaggcatatctccaggcagtcagagcacaacatatttgcatggattataagcctgaactgccccaccctttctgtgcagaaattgtggtgcagtggggccctctacactctatgatgaggcagataaccaggcatctggagcacacactttcctgaatcaggagtttaggctgaccttgccacttgtgcagagaacttcaggcaaaaaaggtttcccagccccttgcccagtcacacctttgggggcttggtggcccttcactcatttcttccttggtgctgatgcatgtggctgacactgggggacctgtacatgggcctgcccggtctgacctcacccatctgggtccccaaacccctcaggactgaggagacagctcagacaactgtgggctccatggatgagcccattgctagaggtagaagctagagcttctactggtaaacaagaataaaatatatacccaggcatgttggccacaaccagctcttacccataagtaccatctactggcttgtaagtcaaaccacagaactcaatataaatttaccaagaggaagtgcatatggctatagaagcaaaacaaaaaaccatattcaacattctctatggtcacaccccacagggagtggggggaaagagaaagggaaagaaaaaacccgctaatgatattatagggaaataaagaaaaaagggaaaaatcctacacacagttaaataattataaaaattagaagtcctattatctctggatgagaaaaaaatggtgcaaaaattctggcaccatgaaaaatctgaatgtagtgatgccaccaaaggatcacagtagttctccagcaatggtctccaaccagaatggaaattcagaaatgacaaagaatccaaagcatgtattgagaggaagctcaatgatatctaaaacaaggttaaaagtcaacacaaataaactcctaaataaatcaatgaaatgaagaaagagacaaacatcttaaaaagaaatcaatcagagcttctagaattgaaaaactcaaggaattgcaaaatataattgaaagctttaacaatagactggactagaaagaagaaataatttcaaagcttgaagactagtcttttgaactaacccagtcagacaaaaattaagaaaaaaaatttagaaaaatgaacaaagtctttgagaaatatgagattgtgtaaagtgaacaaaccaacaaattattggcattcctgagagagaaggagaaaacataagcaaccttggaaacatatttgaggggctaattcaagaaaacgtccctaatcttgctagagaggtagacatctagatacaagaaatccagagaacacttgcagtatcccatgcaaaatgaacatcaccaaagcagttacccaccagactgtccaagatcaacactaagaaaaaaatctcagaggtagctagagaaaaagatcagatcatgtacaaaaggaaccacctaaggctaacagtggacttctcagcacaaacctgacaagtcaggagaggctggggtctatttttagcacttttaaagaaaagaaattccaaccaagaattcacaacttgtgaaattaagctttctaagtgaaggagaaataaaatattttaaagacaaacaagtgctgaaggaatttgttactattagaaccggcttacaagagacccttaagggaattataaacatggagacaaattaatgacacctgctaccataaaaatacacctaagtgcatatctcacaggccctataaagcaaccaaacaatagaaactataaagcaaccagcaaacaacttcacaataggataaaaatcttgcatatcaatattaaccttcaatgtaaatagtctaaacaccccacttaaaaggcatagagttgctagttggataaaaaacaagactcatccatctgtggtcttcaagagacccatctcaaacataaacacactcataggttaaagtaaagggctggagaaggttctataacacaaatagaaaacaaaaaagagcagtggtcagtattcttaaattgcgtaaaacagactttaaaccaccaacattaaaaaaaggaaaaagaggggcatcaaataatgaaaaaaggttcaattcaacaagaagcctttactatcctaaatatatatgcatccaacattggagcacacagatacataaaacaacttctagaactgtagaaaaaacttacacagccacacaataatcatcagggacttcagtaccccaatgacagcattagatggatcatcaacgcagaaaactaaaagaaattctgaacttagacattttgaccagttggacctaatggacatctatataacactccacacagaaaccacagaatatacattcttctcaactgcacatggaacatacaacaagattgaccacattcttggccataaagcaagtctcaataatttaaaaaaaaattgaaattacaccaaccatactctcagaccacaatggaataaaaatagaaatccacaccaagaaaatcccctgcccccaacagcacaattacatggaaatataacaacttgcttctgaatgtcttttgggtaaaaaacaaatttaatgccaaagtcaaaaaaaaaatctttgaaataaaagactccatataccaaagtctctgtgatgcagcaaaaacagtgctaaaaggaaagtttaaagcactaaatccctacctcaaaaacttagatctcaaattagtgatctatcattgtacctagagaaacctgaaaaacaagaacaaactgaccccaaagctagcaatagaagagaaataactaaaacaagaccagaactgaaagaaattgagacccccccaaatccatacaaagggtcaacaaaaggttcattgtttgaaaggataaacaatttcaatagaccactacttagattaaaaaataaacagaagaggtccagataagcacaatcagaaacaacaaaagtgacattataaccaataccatggaaatgaaaaagatcctcagagagtataatgaacacctctttgcctgcaaactagaaaacctagaggaaatggataaattcctggaaatgaacaacctcccatgactgaatcaggaagaaattgaaaccctgaacaaatcaataatgagttctgaaattgaatcagtcacataaaaaagccccaaaccagagagattcacagctaaattctacccgacaaagaaaagctagtatcaattttactgaaactatttcaagaaatcaaggaggaaggactcttccctgactcattctatgaaaccagcatcagcctaatactaaaacctggtaaagacaattaaaaaaaacctgcaggccatagacacaaaaatccttaacaaaatactagcaaatcgaatccagcagcacatcaaaaagttaattcaccatgatcaagtaggcttcatttctgagatgcaaggttggttcaacatacacaaatcaatacatgtaattcaccacataaacataattaaacccaaaaatcatacaattatctcaatagatgcataaaaagccttttataaaattcagcatctcttcataataaaagccctcaagagactaagcatcaaaggaacatactccaaaataattagagccatctatcacaaacccacagccaacataataccaaacaggcaaaagctgaaagcatttgaaaatgtttcttagaactgggataaaacaaggatgcccattctcaccactcctatttaacatagtactaaaagtcctagccagaacaatcaggcaagagaaaaaaataaaaagcatccaaataggaagaaaggaagtaaaactctttgtccacactgctgataatgattctatacctataaaaccctaaagactctgtcaaaaggctcctggaactgacaaacaacttcagtaaagtttcatgttataaagtcaacatacaaaaatcagtaccatttctatagaccagtaacattcaagctgagagccaaatcaagaatgtaatctaatttgcaatagccatacaaaaaacacctaaaaatatatctaaccaaggaggtgagagatctctacaacaagaacttcaaaacactgctcaatgaaatcacagatgacacagacggaagaacattccatactcacaaattggaaggatcaatatttttaaaatggccatgctgcccagtgcaatctacagattcaattttattcctattatactaccaatgttatttttcacagaaccagaaaaaacaattctaaaatttatatgaaactcaaaaagagcccaagtagccaaagcaattctatgcaaaaagcagcagccagaggtatcacattacctgacttcaagctatactacaagcctacagtaaccaaaacagcatggtactggtacaaaaacagacatattgatcaatagaatagaatagagacccagatataagccacacacctatgaacatctaattttcaataaagtcaagaaaaataagcaatgggaaaggactccctattcaataaatagtcctgggatagctggttagctgtatgcagaagaatgaagctggacccctacctttcaccatatatgaaccttaattcagaatgaattaaagatttaaaagtaagacctccacctataagaatcccagaaggaaacctaggaaataccattctggacagaaataaattctgccttgggacagaatttatgaataagtccttaaaagcaactgcaacaaaaacaaaaattggcaagcaggacctaattaaataaaagagcttctgtacagcgaaagaaactatcaacagaccacacctacagaatgggagaaaatattcagaaactacacatctgacgaaggtctaatatctagaatctctaagaaacttaaacaactcaacaagccaaaaccaaccccattaaaaagcaggcaaaagacatgaacagccacttctcaaaagaagacaacaaacatatgaaaaaattctcagcgtcactaatcatcagagaaattcaaatcaaaaccacagagataccatctgatgtgtcagaatggctactattaaaaagccaaaaaacaatagatactggtgaagctacagagaaaagagaacatttatacactgttgatagaaatgtaaatttgtttagccactgtgaaagcagtttggaaacttcttgaagaatcttagaactacaattcagtcaacaattccattactggagatatatatatatatatatgaatataaataattctaccaaaaagacacatgcacttgtatgttcattgtagcactattcacaacagcaaagacgtgaaatcaacctaagtgtccctcaatggtggactggataaagaaaatgtggtacatctatactatggaatactatgcagctataaaaatgactgatatcatgtcctctgcagtaacatagatgcacctggaggccattatcctgagcaaattaattcagaaacagcaatctaaatactgcatagtctcacttataagtggggcctaaacattgggtatttattgacataaagatgggaacaatagaaatgggggactactacaggggaaagtgagagaaggggacaaagagttgaaaaactgtcaggtcctaccttggtgacagaatcatttacattctgaacatcagcatcacgaagtatacccatgtaatgaaactgtacatgtatccctgaatctaaaataaaagttgaaattataaaaaaaaagaaaataaggagatagaatacgaaaaatggcctcccaatattttccagcttaatgcctggaactgtgggtatgatgagatatcattcctgtgtgttaccctatattgaaaagggagattattgaggtataagtaatctaatcacatgatccatttaaaagcctagtgttgtctccagttgagaacagagaggaaagtcagagacatcccaagtgtggtgaggatacggagcaagagaaactctaacattgctggagggaacataagatagtacagcaactctagtaaacagtttgataatttgttataaagttaaacatacatctttataacccacctaggccacagcacagcagtaccctacagaaatgaacactatgttaaatcaaaacctgtatgcagatatttatagcagcattcttcattatcaccccaaactagaaataccctaaatgtccttcaactggtgagtggataaagaaacagtggttttgttgctgagaagtattccatgttatagatgaaatactactcagtaataaaaaggaatcaattgctgatacatgtaacaccatgaatgaatctcaaatacattgcactgagcaaaaacaaaacaaaaacaaaacagattcaaaggttgactattgtatatttccatttatacgactttctaaagaaacagacactatagagacagacaggtagtggccaaaggttaggaaatggggattaatattgaccacagaggggtaatactaggggatcttgaggggtgagtgaactgttctgtatcctgattctggtagtggttatgtgactcagaactatacaccacaaaagagtgaattttattgtacataaataaaaaataaaaacagtgaactgctttgattagcttctacattgtaatctaagattttaaactcaaatttgtatttatgtggcaatgaagggcatgatgatactcaccaagtagttttaggaaaaaatgatttactcagtttaaatatttaccttgaaaacaaacctataaggtgaacacaatctcatttttaaccgcattaaatattagttttcttttgtttttaacttgaactacattgaatatcttttttctaagctgccttcgtctaatagacattgctcaggtcttaaagaatcatcaaagcatggatttttttctctccaccgagctttgataagaaagaaaacaaaagcccacatatatttggataaagtgcagcaatctgttccaaatatcatgtaaaatgtcttcaaaacctaaataagcatgctttttgagcttcatctcctgcctagttctccactcaacactcccaccacgatgaactaattaacaacagtaatatggttattacaaattatttaccatcttctctgtgacagacactttgctagatgctttacatatgccaccacattccaggtaaaataatggttcctattttacagacgagaaaacacactcatctaggttaaacacttgcccaagttcacgtatctggtaagtggacagagctgtaatttcactgtgcgtctgagtccagatggctatgccctttctattactactacaccacactgatagttttcttattttcccttaatagtttttcaaatgtgatgccttttttcaccttatttctagcaaaccgactgacagtcttagaggagaacagtgtcccctctagaacgtcttccctaatctgctatgttgaatagaagaatagattggaaccgtaagaaacagcccagttcttatttcaactcagctacatattcatatttccacacagatggatatttattgagtaccccctgtgtgcgagggattgtgttaagcaatggagattagatcaaaaattttataaaagaaataaaccataagaaacttttgtggggatcttatgagtaggaaataagcagaaaagtccactccaggcagaggcaaacagtactaacaaagaaacggaaaaaaaataaaataaaaattatgctctgagaaactaccctttctgccccttaaatgctctttgcttctcttcacagctgtctgacagtgggaattggatgctctaactgcagtgaaatgaccaaggcgtatggagttactgagtgagctgtttgtagagtaatataagctcaaagaatagctagctcaaggagtggaaaggggaaagatggaacgcacacctcaggccaatgtagatttttactccaaatagaattttcatagcctctttaattaaaaagatactatgcaaggctgggcaaaacttgtccaattctgagctacccaagctaagtctttacttcatttaaatcctattaaagcacaatcttctcaaatatccttttatgacatctagaaagtcttattcttcaatttaattttatgagagtgtggattaaaaatatatatgaaaaacaaaaggaattatccaaaaaggcatttccttcaggaaagaaaaaaaaagtcctccacaaagtaaaaggaatattttagttttattatttttttgttcctcttacacatgaggaataaaaagagaatggaaagtctaaaaatcggaattaaaagctactactgcagcgtattttaaattttattctatatagctttcagagaggaaaagcgattctgttattaccctgcataatttttttatagcagagcatagatgtgttgctaatccaatgctaaaatgactatttggcttattcagaattatttgaaccattaactcgcatgagataagcatgatatgcattaatccttttgtgatctaattcatcagtctttccaagttactaaagctattcttcacagattctttattcttctatcctgaaaatattgtgttttgtttattctgcttatcacaaatcacagagaagtttcatttgctttcttactatttccttttaaaaataaagtcacatttatattgtcaggtaaaatacctacacagaggaaccaagaagaatcggcaataataagtggttttgagactggaaagagaagcagtagagaaagtggacaagcagtgatgaaaatttacttgactacacaatggatttgcatgggaaatattgccctgaccattccatatttgggtaggtactatttggtaattggtgttcattcattagtgggtatgatctaaatatggatttcaaaatacactatgaaagaaattccagatcagacttttgacttgaatggaatatttccataagctaaagatctacagctgttcattaatttcagaccaacatttttggaaagtctcaaaccactccatatttccatgaggagtgcctagaaatgaacctagaataaaacatgctcatttttacaggcacctccgagcttacagtttcttatctgtaaagggcaacattatgcttactatcttcataggattaagagcagaaaaatcatatggaacttctacccagaaatttctttcataagaagcacaaaatacttagtgagattttgtttaagtctgtccttgggcatgataaatcaaaactacatctgtgtatgagacatggatcctgtattataaaggaaatcttcagaaagtctaggcttttcttgttgaaggataaagcttagttaacattatttggggatgatctagctagagagcaaccactatagaaaattattacttgcttaatcaggacttgtgctatttcagataacattaatgtaggagtgaaagttaatcttatttactgattttttattagtaggcaaaccagaattttaacaagatattggaaatgtttaaaaatattaatgcatttttgagctttccatttctaccattttaaaaagaacttgtgttttatagtgtcctgtgttaataaaaagctattcttacttatacataaaataaagatgctagagatctattttattagcctaagctagtataacgtatatttaaaataattttaaatatttttcttagaaattataaaagttaaaattgaaaatttaattgatttcttcccaatttataataattattcctgtattctaccaaccaacatttatttagtttctattgatttatcagagtagtcatttgatcacactagagtgggattaaaaaataagcacaatttttttaatttcaaatatcttgcagcctcggaggaagaaaaagatatgggcatatgtaattatataacaaaatagaaccagaaattttagaaaatgtgatatgtgagttatataagggaagcatgccatttggggaatcaaaaaaagaacaagattacagaagaaatgtgagattactcagttctttcttttttctggtcatggaaaggttcagactgaacactgaaaattttttggagaccagctgaaaaaccatgccatggtcataatttgtcattttactttttatcctcactaatattcatgagtcctcaatctttatttttagattccatatctaaagttaatactcaagattatcgatggtattctaaactaagttttgtacaatgcacttttctgaacatctaagttatctgaaaacaacagttgtgaccttcattactgttatagatacagagattaataagaactgatatagaggtgggtaaaaccattgatatagagattcgtaagactcctggtcttagaggaggtccatccattaaaggaagtggattcaagaacatataaatctaatatactgtaatagcacaatgtactgggtgatcaaaaagaggcccttgtttgaaaatatcacacatttctgaaaaccatgtcttaaaacaaaaagtgaaatatctagcatagtgtgctaatcttttcacctctgaagacaatagaaaagattaaattagtaagtaaaggagagaagtaataaagaaaaaaaaaacagaaatctaaaaccaaaaacttagtaagcagtactaaaagaatgtgtcaaaacatgaaggccagcttatcaagagaccatccaaatgctacctatataaaaatgaggaaaaatgcaagcatggctattgggaatcacaaggacagaatttcactcatatcacttcaggctgatgtggtcaaattgattaggaaatgctggaaaatgggtctgcagagtactagccaattgatgaggcagcattctacagggtctcaatctaatttagtattaaatactaattagcatcaccaatttcagttcctgatataacagagtaatgaataccagatcaaacttcctgccataaacaactatatgactagaagttaatattttcagacatggataagagagaacacaaggctgtgatctgtgaaagaaaaacacaccaagtgagatccatactgatcctgaattgttgccagagggcacatttcgagtcttgacatatggagtggagcccatgcaaggaggagcattctcagctggatgaaggaaacacattggactacagagattgtgaggggcaggaatctttcagcagggaagaggacaggaggacgctctgcagataaggagctccagaaatctgcctacgagtctcctagactgtagtgagtattacagtgtacataagcaaggctagactttgtgaggtctagcagagaataacttctggggaattgtgagctgaatagagtttctgaagcctgcataatatggggaaatactgtagttctgacattcagagtggagagactttcctaatgcctcaagcattcagctgaaatttcataaaaattgcaaataaagaatagggatacacgagccttaaagtagtctttagacccattctaacaaagccaaatccaagtctccacagcataaatctgattctccagaaaattaactatcctctgttagaaagagacaatgctttttaaagaaagacaataatatttcagctctaaatatgaagtgaccacaatgtacatcagaaaataaaataactactagaatgtgaagcaggaaaatatgacacataattgggaagtataatgtcaacagatgtggataagactgatgctgtaattagcagataaagattataaaagtagctatcataaatatgttcaatttttctcttcaaaaagataaagtaagcatatacttatttccttgatgagattatataatctcattaaagaaaaactacaaaaaagaatagaaattctacaactgaaaactacaagataaatttttaaagaaattataggctgggcgcggtggctcacgcctgtaatcccagcactttgggaggtagaggcaggcagatcacgaggtcaggagatcgagaccatcctggccaacatggtgaaactccgtctctactaaaaatacaaaaattaactgggcatggtggtgggagcctgtaatcccagctacttgggaggctgagggaggagaatcgcttgaacccgggaggtggaggttgcagtgagccgagatcacgtcactgcactccagcctggcaacagagtgagactccatctcatttaaaaaaaaaaaacaaaaacaaaaggaattgtatagccttatcagtagatggacaatgccaaagtaatattagtaaactcgcagacaagaataaaaggagtcatacaaactaaaacaaaacaaaaaactgtaacaaaaaaaaagaaagaaaagagcttcaatgatctgtgagacaatgtcaaatagtccaaatagtctaatgtataattgaaatgctagaaggagaagagagagaaaaatttggcaaaaatattatttgaagaattaatgatccagctgctgaaaacttattttactattttaccgaaaataaaattttaaaagctgtcagaaaaggtacattacatacaagagaaaaatgataagagttgttgctgacttatcagaaacaaggcaagtaagaagaaaaggggacatgatagggctgaaaaaaactcttgttcagcccagacttctatacccaacaaaatatctttcaaatataaaggtaaaataaagacatttcagtaaaaaactaaaatgaggagaattttaaaggcaagaaatgtcataatatttttatgttaaaggacgatggaacacatatctagttgaaagaatgaattgcacaagaaatggtaaaatgtataggtaaataaaacttgtgtttcttggagagttaatattttgaagagagactgcagtaagttaaacatgcacattataatctctagattaataaatagtaacctaaaaaggcatggcaaaaatgtcaataaaggagaggaaatagaatactaaagattattcagttcaccaaaaaggaggtagaaaaggagaagttgaagtaacagagcaaacagaacaaatagaaagcaaaaatgaaataacaaagagaaaatatagaaaagtagaaaataaaatcatagtgtgcttaatctaaattgtaaataattacattaagtgtcaacagactaaatggcccacttaaaaggcaaagactgtcagattatatttaaaaagcaagagtctggctgggcgaagtgactcacgcctgtaatcccagcactttgggagaccaaggcaggcaaatcacctgaggccaggagttcaagaccagcctggctaacatggtgaaaccccgtctctactaaaaatacaataacgtagacaggcatggtggcgaatgcctgtaattccagctactcgagaggctgaggcaggagaatcgtctgaacccggaggcagaggttgtgatgaggcgagatcgcctcactgcactccagcctgggcgacattgtgagactgtctcaaaaacaaatgaatgaataaataaataaatacaaaaattagctgggtgtggtggggtatgcccatagtcccagctactgaggaggctaaggcactaaaatcgctagatcgttagaaccgaggaggcggaggttgcagtgagctgaggtcgcgccgctgcactccagcctgggtgacagagttagactctgtctcggaaaaaaaaaaaaaaaaaaaaagcaagagtcaactatatgctgtttataaggaatattctttaaacacaaagacacaggtcaaaaggaaagggatggagaaaacatcatgaagatgttaatcatgtagaagccaatatagttatatagataccttacaaattagacttcaccaagtaatgcattatcatagataatgatgcatattttataatgttgaaagtgacaactcatcaagaagacataaatcttaaatgtgcattcatttcacagaaaatctctcaaactctcaaagtttctaaactaaagggagaattagatttgttcacaatcgtagttaaaaacagtaacaccagtctttcagtaattgttggaagaaatgaacaaaagtctgtaagatatagcagttttgaataacattataaatcatcttgacctaattaaaacattacacataagaactgcaggatacatattcttttcaagatagatcatctactagtttatttcagactatcaataatcacatagattgcattctctggccaaactgtcatacattaaaagttaatcattattttaagaaaatacgcacatatttagaaattaaacaacacagttctaaaatacttatgtgtcagacaaggaagcccaatggaaatttttaaaaattactgaacataaggaaaatacaaacactatgtattaaaatttgtagaatgcagttaaagcagttcgtctgggggaaatttatagtgttacatgtctacattagaaaggaaaataaaagctataaaagcaatggtctaagatttcatcttaagaagataaaataaaaaacaaattaaattgaaagtaaatgaaagggaatgttaaaaatgagagtgaaaaaaagacaaaaaaaaggaaatcaacaagatcaaaatttgaagaaaagattagtaaaattgattaataaaactcatcacgatgaaaaggtaaaacaagaatcagcagtatcagaagcaaaagaagggacctttctacagacattataaagatgataaagaaatattatataattttatgctaattagttttacaatatagattaaacgggcagattccatgaaacaaaacttagcaaaactaatagaacaggaaatggaaagtgtgaccaaccctgtatacattttagaaacttaattttaattaaataattcttaggcacaaatggcttcactggtgaatactatcaaatatttaagagctgtacaatatccatttagcatattctttttcagagaatagagatggaaatcttcgcattttattttatgaaaatagcatatctttgataccaaatccagacaaaggggaaaaaaacccctcaaaatcctgaccaatacctctcatgaacccagacacaaaaattcttaacaaaatattagtaaacaaaacccaataacacatttttttaaaaaaaggttctatataatgactaaatgaatttagtacaggaattcaagcttggctaaatatacaaaattaaattaatgggatttactccattaaaatattaaagaaaaaaagcatataatcatttagattggctcaaaaaatctatttttaaaaactaaacagtcaatcatggaaaaattcttagcaaactagaaatggggggaagtcttcaaactaatacaatgtatctgctaaaaacttatagctaatgacataaatgattataaaatattcaacacttttcttctgagatctagaaaaagacacagatgtatattgacagcatttcatttaatattttactagaggtcctagatagttcagtaaagtaataaaaataaatggcatagagattgtaaagaggtaaagccattgttgtttatagacactgtgattgtgaacacatacagttctaagaaatccgcagaagaaaaattcctgtgaaactaaagtgaattcactaatactgcagaatacaatccaatctagaaaaaaattcggattctatataccggcaataaacatttgaaaaataaaaacaaaaatgtcattcaaaatattcaaatcataaaacttttagggttaaatttaatgggtggtgtgcaagaatgctctgctgacacaattaaaatattgctgagagaaattcaagaaagtccaaataaatggaatgatataccatgcttagggtttggaaggctcagtattaataaaaagtcttttatctttaaatagatctaaaaattcaatgtaattcttatcaaagtctcagaagccttgtatttttaacagaaacaaatggattctaaagtttatataataattcaaataatctaaaatggccagaacaatctaaagaacaaagttggataacttaaaaacttaccgtaaagcttcagtaatcaaaatagtgaggtattcacattaatataagcaaatagatcaatggaacagaattaagagcccagaaatagatccatgcttacatactcatatctgtgtgtgtgtctgtatgtgtgtgtgtgtgtgtgtgtgtgtgtgtgtctgtgtgtatgcaaaggtaccaaagcaatacaatggggaaaataagctctttccaacaaatggtgctgctgcaactagatattcatataggaaaaaataagcaaactttaacctctacttcatatcatatcattttcaatgaaccaggataactaaaactataaaaagtatacaaaaaatgtacaaaaagatctttttggtcttaaggtaggcaataatatctgaggcagaacacaataggcattaaccattaattgaaaaatgaataaattatatttcatcaaaatgaaaaatcttctcctcattaaaaggcctttgcaatgtaaagctatttgttgctccatggttgcctgaatgccagcacccacccccacttgttttgaacttttacctagtcattgcccatctctgggtactcatccctaacatgtatattttcaagcaataagtctcatgatgacttcaccgttttaccccttctttcctttccatagtaactcagttacattcaaattacccataagaaggcttcctgcatgccacagctacttcacccatgaccctcagtaaagccacttgcctagaggtccttattctgtttcctccctgcctgccacaaacgtttggcttttgggtgactttgcatggccctctgagcatgtggtgtctccttctctaggacctatgagtataataaatcctttaatttcttatgcctctccagatataatttccgtgaccatactggagtgaaccttaaagaccccacaaggggtatttcctcccccacttatgacacagccttaatgagaaataagcctgtaacagatagaaaaaagtatttgcaaaacatatatctgacaaagaacttgtacccagaacaaatatcttagtaatacaaaataaacatcttaatattttttaaacttttattttatatttaggggtacatgtgaatatttattatataggtaaatttgtgtcattggggtttgttgtacagattatttcatcacccaggtattaaacctagtacccaatagctatcttttctgctcctctcccttctcttccccaatcaaatagaccccagtgcctgttgttttcttctttgtgttcatgacttctcatcatttagctcccatttataagttagaacacatggtatttggttttctattcctgcatttcataagaatgaaaacagaaatctcacgaacgtctcaataaatcatctatgtctagaataccccttctctgtctcctgagttcaataatatattctacttaaataactgagaatggacggcaggccttatttgtttacatggattccatgaaatgcaggagctacattttctgttactgctattgtttgttagggattagtacccagagatgagtacccagcgccatccgcgatcctgcaaaagacacggtcctgttttttaagactgcatagtatcccatggtatatttgtacctcattttctttatccaatctgtcattgatgggcatttagattgattccaagtctttgcttctttgctattgtgaatagtgctgcaatgaaagttcacatgcatgtgtctttatgttagaatgatctatattcttctgggtatatacccagtaatgggattgctgggttgaattctagttctgcttttagctctttgaggaatcctcatactgctttccacaatggttgaactaatttacacccccaccaacagtgtataagtgtttccttttctccacaccctcgccagcatctgttattttttgactttttaataaaagccattctgactggtgtgagatggtatttcattgtggttttcatttgcatttctccagtgatcagtaatgttgatcttttattcacatgattgttggctgtatgtgtgtcttcttttgaaaagtgtcccttcatgtcctttgcccactttttaatggggttgcttttcttttatacatttaagttccttatatatattgggtattaaacctttgtcagacacacagtttgcaaatattttcctccattctgtaggttgtctatttactgagagtttcttttgctgtgcagaagctcttaagtttaattagatcccatttgtcaattttgcttttgttgcaattgattttggtgtctttgtcacaaaatctctgcctgttcctatgtctaggatggtattgcctaggttgtcttccagggtttttatagttttagattttcaattgaagtctttaatctatcttgagttggtttttgtatatggtataaggaaggggtccagcttcaatcttctgcacatggctagccagttttcccagtgccatttattgaatagggagtcctttccccattgcttgtttttgtcagctttgttgaagatcagatagttgtaggtgtgcagcatcatttctcgactttctcttccgttccattgaccagttacttcacaaacagttatttacaactagacaacatgcacgtgaaaaactattcagcatcattagccatcagggaaaatgcacattaaaaacacaattgattatcactacacacccaatggaatagataaaattgaaaacactggtgacaccaaatgctggtgaggtgaaacaactccaatacccatacattgctgttgcaagtataaaatggtactgccattttggaagttctgatagtttcttaaaaggttacagatatacctaccataagattcagccttttcactgttaaatatttacccaataaatattaaaatctatgttgacataaagacttgcacacaaatattcatagtatctttattgatcataaccccaaactgaaacaccccaaatggtcatcaaaaatcaaaaggaaaatagataaactgtgatagaatcgtacagtgaaatgctgtctggaagtaaaaagcaaagatcgattgacacatgcaacatgcgtgaatctcaaaaacatgatgttgagcaaaaatgtcaaacagaaaaagaatacatattaaaggactatattatatgaaattctaggataggtagaactgacctatggtgaaaggaatcagagcattgattctctctgagagagtggttgattgagaaaggatccaaggaaattccctggggtaatgaaagtgttatatcttggtggaggtgtattacatagacatttacacttgtcaaaattcactgaattttacagctatggcatatgcatttcactgtaaataaataatattttcatttctacaagactacccatgtgattagtaataaaacctgatacttgcttctgcctttcctaggagagccatttaatttcttttctcccccattactgggatgtacaacaaatgataatcaaaatagcagattttgacagtactgaaattggtcagaacactgggaagatactgcataagacaaaagaactcacttaaatgataagaagaaatgggctgaattcagaaaaccagctgaatttatttaatatatttttccctaacattttctacagtaagcccaacatgatgtaatatatgagggtattaagaagttaaggcacacttggaaaattgccattcagacttatagattaaacaaatatcagatgtggaactacattcttaatcatgaaattttaacttatactgtcagactatacaaattatttggaacatttcctccctcttcaaacatttagaactataggggccaggtaaacatcaaggagaaattatgcataaataatacaggcactgtgctttcacagagtgtttttcctggtatttaacatttgccagtgtgtctactgtgtgcaaccttccccctcaggatttagctgtggtggcaataaaggcagtgaagttaggaagactctcatcactactatcaacagccacattgtgttcagcttcttggttgacttaaattgtgcaatcagggtctatccacacattcagctatattctgtcacttatgatggagccttttgtgtctatgagttaaaggtgtccagggagggaaatgtaatgccctgactcattccaacctttaaaaacaaagcattaagtcaagaatatagtaaagaacatcccagtttcacatgttcaaactttggttgaactaatttgtaactgcaaagaccattccaaactgtgtctagtggtcaagactcctttatgtctctttctctatttggaatgttttctctctctttttccctgatggttaaagccctactctgccctactcttcactcaagactggcaaataccacaaccttttcccaataaattacatcatcaactttaggtattttaaatatatttgctcatgtctcttttttacaggactaggagctcattgagggcaggtattttgtaatattaatctttgtccctggggtctggttcacagtacatgtcaaataactgtttgatgagggaccaatgacccgtagaaagcagaaattttgaaataccatcactcctaaaattagattaggtgccaactttataaagataatttcagcttaagatattcagttatgttttagattattttttctcgagttttcctctacagtaatattgctttttatctcaagcctaatctactttcacatctttgagtctgctttcaattttttataggaaatttttttttatatttcattttaaactcttttgtgttttatatttggtcacccttaatagagtgtgccatttatccaccatgaaactaactctgtccagattactcaccattttatgttccctgtcagctttcttcacatcagcaaacctgaacacttttcaagctatattcctatctagggcattcataacagagagtggtttctgtcatcatgaataacttttctttctttcctaaaaacaaattggggattattgtacacaatctctctcacataaggctttctgatttgtctgatttattccagtatgatatgcaatatcaaaagtacattggaaatcttaataaattatctgtacctagagtacctcttctgtctcttgaatgcaataatatactctacttaaataactctgagaatggatggcaggtcttatttgtttttgtgaatcccagtttacaaaaaaataaaaaaggtgtttttttttccagatgactgcatatgtatttcaccttttatttgtttactttttattgatttaaagtcatatacaaaagcaaaacaaaataagacaccatgtctggctgtatatcaagcataaaaaacactataattaggtaaagtttcagcaaacaatcagcaacaagatggtttagttcctggacaacaataatgaaactcaatgactttgttagtccctcacactgtcatgattggagataaaatttttaaaatcctatgccaacaaatcaaggacagtagtgtcactgcttgggtggcaggggaagcttgccatataaaaaggtgaaagaccttttcaactattttggtaagagcacctcaccttgatttctgttctttttggcaaatatttccaacacgaagtctctatgcaagagttgactttgaatagtataactatcattactattgtatttgattatcttccccaaattattcttattctagtgtttttcaagttttaatgaattctgattctattagactactaatgtaatgaaagcactctaccctttcaccaagaaatgtgcatctataattctctatacaatctcacagaatagtatgatgggaaaagagatacaaaacaaacacaaataagaagaaaccatgcaaatacatggaaattaaataacctgctccttttgggtcaaaaacgaaagcaagatggaaatgaaaacattctttgaactgaacaaaaataatgacacaacctaccaaaacctctggaatacagcaaaggcggtactaagaggaaagttcatagccctaaatgcctacattgaaaaggctgaaagagctcaaactgacattctaaggtcacatctcaaaaaactagagaaacaagaacaaaccaaacccaaacccaacagaaaaaaggaataaccaagatcacagcagaactaaataacatagaaacaaacagacaaaaaatacaaaagataaatgaaacaaaaagctggttctttgaaaaaataaataaaattgacagactattagcaagattaagcaagaaaagaagagagaaaatccaaataacctcactaagaaacaaaacagtacatattacaactgacaccactgaaatacaaaagatcattcaaggctactatgaacacctttatgcacataaactagaaaacctagatgagatgaataagttcctggaaaaatacaacctttcctgcttaaatcaggaagaattagataccctgaacagactaataacaagcagagagattgaaatggtaatttaaaaattaccaacaaaaagtccaagaccacacggattcacagcaaaattctaagaattctaagacattcaaaggagagttggtaccaatccttctgacactattctacaagacagagaaagaaggaaatctccataattcattctatgaagccagcatcaccctaatacccaaaccaggaaaggacataaccaaaaaagaaaactacggactgatatccttgatgaacacatatgttaaaatccttaacaaaatactagctaactgaatccaacaacatatcaaaaaaataatccaccatgatcaagtgggtttcataccagggatggagggatggtttaaaatatgcaagccaataaatgtgatacaccacatatgtataattaaaaacaaagactacatgatcatcttaatagatgcagaaaaagcatttgacaaaatccagcactccattatgattaaaactctcaacaaaattggcatgcaagggacataatgtaataaaagtcatccatgacaaacccacagctaacataatacagaatggcaaaacgttgaaaggatttcctctgagaactggaacaagacaaggatgcccactctcaccactcctcttcaacatagcactgggagtcctagccagagcaatcagacaagagaaaaaataaagggcatccaaactggtaaagaggaagtcaaactgtcactgtttgctgatgatatgattatatacctagaaaaccctaaagactcctccaaaaagctcttagaactgacaaattcagcaaatttccagatacaaaattaatatacacaaatcagtagctgtcctatacaccaataacaaccaagctgagaatcaaatcaagaactcaaccccttttacaatagctataaaaaaacaaaaatacttaggaatatacctaacaaaggaggtgaaagacctctacaaggaaaactacaaaacactgctgaaagaaatcacagatgacctaaacaaatgaaaacatatcccatactcacgggtgggtagaatattgtgaaaatgaccatactgccaaaagcaatccacaaattcaatgcaattaccatcaaagtaccaccatcattctttacagaactagaaaaaacaattcccaaattcatagggaagcaaagaagagcccacatagccaaagcaacactaagcaaaaaagaacaaatatggaggcaggtaccacattacctgatttcagactatactataaggcaacagtcaacaaaacaacatggtactgatataaaaataggcacatagaccaatggaacagaatagagaacccagaaataaacccaaatacttaaagccaaatgatctttggcaaagcaaacaaaaacaaagtaaagaaagaacaccctattcaacaaatggtgctgagatatttggcaagccacatgtaagagaatgaaactggatcctcatctctcaccttatacaaaaatcaactcaagatggattaaggacttaaatctaagacctgaaactgtaaaaattccagaagataacatcagagaaatccttgtagatgttggcttaggcagggatttcttgaccaagaacccaaaagcaaaggcaagaaaagaaaaaaacaatgataaatagctgagacttaattaaactaaaaagcttttgaatggcaaagggaagagttagcagagcagacaacctacagagtgggagaaaattttcacagtctatacatttgacaaaagaacaatatccagaatctaccacgaacttcaacaaattagcaagaaaaaaacaaataatcccatcacaaagtcggctatggacatgagtagacaattctcaaaagaagatacacaaatggccgacaaacatgaaaaaatacttaacatgactaatgatcagggaaatgcaaatcaaaaccacaatgcaataccaccttactcctgcaagaatggccataatcaaaaaatgaaaaaaaagtagatatcggcatggatgtgctgaacagggaacacttctacactgctggtgggaatgtaaactactacaaccactatggaaaactgtggagattccttaaagaactaaaaatagaactaccatttgctctagcaatttcactactggatatctacccagaggaaaaaaagtcattatatgaaaaagatacttgcacatgcatgtttatagcagcacaattagcaactggagaaatgtggaaccaacccaaatgcccatcaatcaatgagtggataaagaaactgtgatacaaatatgtatatgatggaatactacttatgatggaatactacttagccataaaaaggaatgaattaatggtattcatagcaacctggatgagattggagactattattctaagtgaagtaactcaggaatggaaaaccaaacatcatatattctcactcatcagtgggagctaagctatgaggatgcaaaggcataagaatgactcagtggactttgaggacttggggaaagggtgggaagggggcgagggataaaagactacaaatagggtgcagtgtacactgctcgggtaatgggtgcaccaaaatctcacaaatcaccactaaagaacttactcatgtaagcaaacaccacctgttccccaataacttgtggaaataaaaaaatttaaaaaaatgtagaaaagattttaaaaaaggatgaggaaatatttacttaataatccattcaacaaatatttattcagaatattctatgtgccagataaaagcagaaaataaaaaaaagacagaaaaactgcagatctgactaccaaatctgatattttgttctatggaaaaaagtaacagcaataaataacaactcaaaatagataaactattcaccaaggcgattaagagaggggtacagtaaaaatacatgaaaattaaaattcaagggaaaaacaaaatttgagggaatttgtcatcagcagacttgccatgcaaaaaatgtgaaaataagttcatcagaagaaggtaaataatataggtcagaaactcaggtctatataagaaaggaagaatgttatagaaagaataaatggtaaaataaaatcttctctgcttcttattcttcaatactctaatagataagtttgttcaaaataataatgtatcttgtgactataatttatgggtgggtgaaatgaataatagtaatgtcataagggaaatgagggaagaattgggaatattttaagaaacttgcactacctgtgaagttgtatagttgtatttgaaattgaacttggattagttgtaaatgtattttgcaaaccccagggcaaccactaagttaaaaaagaaaaagaagaagtctggttaagagacagaaatcgagttgggttttagacacaaactttgagaaacttattaaatatgcaagtatagttggtggggaagatgaagagaaataaggtaagaaaatgaaatgaagcagtcagtaagataggagaaaaaccaagagaggatggtttccagaatgcccatgaagaaagatcctcataaaaggaggttaaaaagtacatttaaaagtatattattagatgttgagtacctataaaacagaatttaaacagtggttgttttggtgtggtggtttttgtgggtgatttaattttttttccattctgtttctaccttttaaaactgtcatgcagtaaatatgcaacactgttgtaataagaaataaaataaaaatcatttttaaagtattgggtcctttactcctacctaagaataaacattctttatttttacctttctactagtgtcaggttctaagtacaatacttagagatacacatattatagggaaatctgttggtaaaaatgtcctagggcacactgttcaatagagatacaataggagatgcatatataattttaaattttctagtatgcacattgaaaaaaatgtgaaattaatattttattaacttagtatatccaatgtattatagtttcaaaaatataaccaatataaaaatattaatgagctatttcacctttttttggatgtctttgaaatcctgtgtgtacttcacacttatagcacatctcaattcatatttaagtgcttgacagttacatgtggctagtatctaccatattggacagtgtgttctagatccttgttcttcaaaatatggttcacagatcagctgcattggcttcacccagaaaaaaataaatgcagaatcttaatccttatcctggagctactatatcagaatctctgtttcttttttttttttttttaacttttaagttcagcggtacaagtacaggtggtttgttacctaggtaaatttgtgtcatggcggtttgttctacagattatttcatcacccaggtattaagcctagtatccattagttatttttcctgattcctttcccttctcccatgctccaccctctgaaaggccccagtgtgtgttgttcccctgtaagtgtccatgtgttctcaccttttagcttccacttataagtgagaacatgtggtatttggttttctgttcttgtgttagtttgccaaagataatggcctcaaaggaatataaattattctactataaaggcacatgcatgagtatgttcattgcagcactattcatgatagccaagacatgaaatcaacctaaatgtccatcagtgagagactggataaagaaaatgtggtacctataaccatagaatactatgcagctgtaaaaaagaatgagatcatgtcctttacagggacatggatggagttggaggccattatccttagcaaactaacacaggaacagaatctgtttctaacaagcactcaaatgatactgttgcagctcgcttcacagaccacactttgagtagcaagactaattatatccagcccaatcattttctagaagctcttcagcagttccttaacctgttttctgctgtaatcctctcttcatgtccatcattcctccaaaaagcaattattatgtgctggttactgcgtgctaatgctttacaagttctatcatccacattttacagaagagaaaacagaagcactaatagattatgtaacttgctcaatatcacccagctagtaattagtggagttgggatttgaaaccaactagcctgcttccagaatccagtgtcttaaccaaccattatttgtttatatatctgtctcttctacttaagatacatctagctcttcaaagatatatagcttatacatcttttttctacaactatttaatacagtaaatgtttttgtaaagaagggagggagggatggcttcatttgtgttttcctgctaggactgcccttccaggtccaattgccccagaatttccagtactcaagatccctgttttataggtgctagtagacatattattgtgtggaagccatggtcagaacacctgccaggtgctatcactgtgtctatcatttcacattaatattaagaaaacatttatgaaattctataatatccaaacagaatttttgctaaaatgttttcctaattaaaaaaaaattagtataaatgataacctaacaggtctgagttttacaagtagaagttttgctaatcagtgaaatgcccataaaggaagtaggagaggagacagtacaaaactgagataattctaagtccaaacaaccactttcttgatatctaggtggtaaattttattgtacatcaattagtgatcctcttttcagattctcttttcattctaatcaatctaattccatttacatttgctcagttaacatgactgctttttggaaagggtccaattcttcttcctttggaaatttcaactctctatttctcatttgactgcaataaagtggctgggatgttcttgagagttatgggtagggaagttctttgtacccttaggtggatgcacgctttggctgtcaacacctagttgcttttcgtaggaggtgctgccaggtcagaaaaaccacttgtatcatagatggccccagtctttgcctcaaataaaacagataccagaaacagggagaagaatctgcccttttctgagaggtacaaagacgaccatggtgtgcatataccctcaccacttaagggctgtgtgccctcgggcaagttactcaggctctctgaacgttatgtttttaactgtgtcaacgtgaactagataaacactatgaatctcaggttccatctgtaatttggcattttgacttatcacctagggtttctgacagcaatgagaaaaatgatggaaaatgtagtgcagagtccagcacctgacaaataataatccattagcattttccttcaatatatttcctactgaactacaggaattttgaggcctcaacttgatattatccctattttaaactttctaatggccagctgcaaacacatccatgtcaactccctccaaaatgttatttgtcctttagatctatttcagatgtatttcttgctgaataatctttgtatgcaatgacccctgtatttacttacaactacatcatcaacatcctaggacagggtctaggttagtttcatttcccttcttgggcatttactacaatgccaggaataaacaggtgcttaataaatgccttttgttaagccaaacgtggtggctcacacctgtaatcccagcactttgggaggcagaggtgggcggatcaccagaggtcgggagtttgagacaagcctgcccaacatgaagaaaccctgtctctactaaaaacacaaaattagctgggcgtggtggcacatgcctgtaatcccagttacttgggaggctgaggcaggagaatcacttgaacctgggaggaggaggttggagtgagccgagatcacgccactgcactccagactgggcaacaagagcgaaactccatttcaaaataaataaataaatgccttttgttgatgctaggcattcctaaagtctttggaaaactttccataaccacccctcctctgcccactccagctctgccctctcacctatctctgcggccctccatcacagaccttattcacttaactgcaaattgggcactgttcctttgtttttattacaaaacatttctaacataccaagaagtaaaacatccgtgatttactctaccactcaatttttcatgaatgttgacattcgttatattattttggttctggtttttaaagatctataaatgtttctgatatagctgtgaaccttccaatcctattctcttcctccctccttggaggcaaccactgtcctgttgtgtccataagtttcatttttgctttactataaaaaaaaggagttacaatacccctcttaaagggttatgaggcttaagcaaaatttatactgtgactgacaaagagttaaaacaatagtagtctctgtcatcctcatcatcaccatcattgttatcctcactcttgaccttattatttttctctgcatattcatatgtctcctccagtaggtctttgcttttctgagatctggaactatttattttctctatatgcctatagcttagcccagttcctgatatataggaagtacacaaaacttgtaaagtaaatacatgctgtaaaggctggactgattaccttccattctctgatttcaggcataatcttaaagcacattaggcatagttcttcaccagttctctaaaatagtaacttgaccagaatatgcaggctaatatccattcaccctcaaaaatccagagtaatgacaatctctttattctttcaaggggccctgatcacctgattgttagtatcacatattcatctccaatacctgacaccagaaaaacaaaaacaaccaggacaaaactaaggttcccaaagtccagaggctgaactaaaagataatggatagatgagcactcagtcttctggcatcctcaataccctctcagccttttagattgttataacccaacttgctgtttccttttcaattatcaagatttacagaataaaaaaaggtgaacttgtctttaaaaattattcgcgataaaattcgattttgtttacttgatgctaaatactgataggcaaggaagtggcaggcaatcttactcggtttcccccatacactaattaaacattttatgcagatatcagcataattaaagaattaggaaacaataagaagtgcttgggataatttgtaatatcagtgcactgatgcattgggtccagataccaggatttgattggcaggactttattaagttttggcagcacttaggtagtctgggagcttttttatgaggctcgtgcacattaatccaagctcctgttgtcgttaatactgatgagtgaaggcagttaattgaattatgtatgaagcactgctgattaaataatatttcactccccactacagaattcgctctgctggattaacatctactgttgtctctgacactgaatgttatacggacctcttctgaagcatacactttgattctttcccatctgttcaactgatgcagcatctcagttgccactggaaccaactatccttcagctctgacatgaggtcactttggagaactgatatagttatttattagcatccgtgtaaccatgaacagaaatcctccccagtgcctcaggtgttctaagggcattattatttaaattcacggtggaatgtgaagaaaaattctaattatttatcattgtattctgcttaaggtgataggaagagaaaataactcaaggtcttccaaatcagccttaaaaataagtattattttgagctgcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatattagaccctaaaaacacctacctcattatatccatatccatggtagagttttgtctgtcaaggagaatggctttaataagatgggccagaaacccttttctaaaaacagtgttaaagaatcacctctcagactttattttcttctagacttttactactcaccaattttccttttctataggtctttttttctttcctatagtttactacaaaagatgcgtgaatggaactgaatgtgatggcaacccagagatcaacaaataggcgtagccatataagaagaaagagaataaaactgataaaatatcaagattatggttgatacacaaagttatcacagaggagtaaaaccatgtaatatgatttattgctcacatctcaagttataaaatatttggtacaaacaaaacaaccaagagaaataaaataaaacccaacacccagcatttggattattagaaaaatgtcattctttaattaaaattgttaattgcttttatgttgtgcttcacgtactacaaataagttaaaaaaatagggaataagatgcttgaaacacaaatgctgaattttatttatatggggtagcattttttaaaaaaatatgcaaacaatgatttaactaaataattgaaatttggtcattaggagaagacatcattcaaccattgagaaaattttaaaaacctcatcaggccactttaacattttcctgaaagttatattaaatccttacatttggtgacattccctaaataaggggaattgggtctaacaaaaagaggatgtaaacagagaaaagtatagccaaggttaattccaaaatttctgtaatatctgagaaagttatgtgttctttgtgcaaaggttctctgactatccaggcctaaggatgactcaactgagatggttggattttcagaactgaattcctgtgttattcttgctttcaaacttttccagtggctgacttttagcagtggaacctaactgggccagcttttgtgtctcctcacatattacatttcttcttccccaaggagctgtcatttttctccttcttgaaataaattcatctaaagagaatttctctcaatcaacttcccatcattctctctggagtcttcagaactcactattatactgtcaaaagcctgccatccatgcattcactcaaacacaactattgaaagcttaatgataatagtagttactacttaactgaactcctcagatatgccttgtcacctgtactgtgggttcagtaataaataaagcatttttgtccttgaggagctcccagtaaaccaagagaggcaaatatgtaagtagttattcatgtcagaggaagagcaccaatgaggaagcagctcattcaaatggtgaccctcccacattccctattcatggtgtcatcatccatcctgtcctccacacttcacaatcatacccctctcctctttcacctttttatattaaatggtgttttctccttcagaaatagctcatatctcttctgtaatgaactaggtcctccacatctctagcctagacaattacaatcacctctttgccactagtatcttccttccttaaattattattatttttaagcggtgctggttcaaaaatttccatttggtctgacttattcacaaaaacaagttcaatctcctcgacatggcccatggtttaaatcttcccagtgtggccctcttatatttctccagcctaatttcctatctcatatttcaggatacacaaaactttccttaattccctaaacatgccctcttctttaaattatctgtagctcacagcatgtacttttctctacttggtaagaatttcttcctgactccatcttcttcataaaaatgcttattcagttgatcagaaatcatgcccacttggcctttttgacacccaccttgtaaagggctaacagatggctacacccaaccacagcagggtaccccaaatgagagcaaaaacttaccttgtaaataacagctgaggaccccactccagccaaacacaaaacaatcacaggtgataaaaacgtcaccaagagaacttctgtaatatgcacaacaatttcccccagatctaaagatgttaataaatttctgaaaatatctaactttctcacagccaacagatgtaggctaggggttcagagcttctaggtgacagatattagattgtaccttaagcttcatgactttcaatccctctgtctggttggtacctgctcagcctttaagttttggcttatgttcaatgtcctcaagagatctttctagatgttcaatccagattgatccccgctatcatctttctcatagaatctggttcttttccttcatagtacttacgctaatttaccattgtagatctattatttgttggctatatttttctgcacttgttcataagctttgtaatgagtcattcatccatccatacctagcgctgttttgttcatccatgcatacctagcactatcctggcacagagtaagtctcaataagtatgtgtagaataaatataattccattttgcatcatgccaggtgacataaaagtgtaaaaaagtagtagatggtatgttcttagtttggtccatggataatcaattattgatgaaaatctacttctatcagggtagctaaatggtttccaagagttttgtctgtatgaggaacctatggataccttgagacaaagaaggaaaaaagtactttgaaatttgcaatcatgctcagcaaagttcttctcacactctccaggggatggaaaactcatctggaggtagaagagagttaagctgtccaagattctttcatgaaacatgttgatttttgtgtgtgtgtatgtgaggtgaaaagaattttagatgtaacacaatgttgagacaaatgttatctgactcaaactgggagaaatcatatttaaaatagcatggtctaaaaaattaaaagaacagggcaatagtttcagggatcatcaaagaaaactgacaccactgagtaaacatcgcaccagagtcccagtgaaagaagcactcagagtaatggaagaaagtcaacataagctgttgtaacaatgtcagcctcctgtgataaccctaaggtcactttcctagtgggaaccaagagacagaaacatatggggatcatggctatcaagtggcaaactggaaagcagcatattaactgtagtatctgccaaggtaaaagataggtcgccctggacccagcccagtgcagacagacagaggaaggattgggatgctaagttgttccattaggtggggacccaggtcaaagcctatgttctttacagaaccatgtcctttgttcacccaccctagactgctacatactggggatcaaggataaaaatgacttctcatgggagtaaatgaaggaacaatgaaagtagtataataattttgtgcttaattacacattcagactgcaggtgctgtagatagctagtgacaagagaatggccatccagaaaagaatgggatacaagtatttgccctcctgcagttcttcatggagtgtagtcagccaagaataaatttaactttactttcttttaatgcctgtccctgggaatttcttatcccataaaacaccaaccttataaaattagagcaccatccctttttcctcgagtggatttctcttctcattttccttttattaattaaaagataatgctctaaactctggcagtaccccttttcactgtgggctcccctggcccactttctgcagtatatcaacttatttatatttatttgtcctaatacctatgttttcaattggtttctattatgcaacacaccacagggaaagagtctagtattaaaatcacactgtgtagtttaattccactttaatgctaggactctggttttaatcaacttattttgatcacagaataattctcagtaataatccaggggtgtcaggcaggccatcagctgagagtaatcaaatgagtctctccacctcttctctctctcttccatatagaatagtgcatttcttccacttcacataaactggagctaaagccaggttccaaattagtctcgtgaaattgtaactgactctctattaccaacttgtaatgggaattaatggagtgaataatctaaaatcatgggtggttctgaattaatgatacttgtcttgagtaacacaatatatgctttttccctccaaaagatgtacatttcttattaatgatgttttcttgatctctaagtagacatcaagaaaaagaagatagtactttttagaatgccaagcaagcgttgtttggggtactttgtaaacactgtcttgtgcaatcactccatgaggaaggtattcttctagtttatggagtaggaagttcagagcagcagaggattgtgggaaaacctctgggctaagagttagggaaaacagttctagatcatcacacaggtattgaaaatgaaggatatgtgttgcggcaatgtagctaagttggaattttgtttttaaaatgttcttttgctgcagttccgagttagtgtgggccacaagagacattttgtgtgggactggaaggcagaagtaaggtgtcagccatgttctttttatgtgggcaagattggtgttgagtatgaggcactggtgtagtgcacaagccttgtcacttttctgccagcctgagttgtgagtgtggggcagtgactgggcctgcagcaccttcagttcctgctggacatcctctgtgtgttcatatctgtgaagaaggatgccagctcttcctgcagatcattccatcatcaaagttgaaagctgggtatggtgagagactgatgtatgtttcagctgtccttataggttccagcctgtccattctgtccttgtttccctgacttcacatctgtcttttcttctctactgctttacatgtgggcttcaggctctagcaccaagacacagaagcagtagcttcatatagactgtttatccagcacccacaattgcgtaacatccaatccttggaataattctttactctttacagctcctatcaggtctgcttctcggatcaaactctgacaatgagcaatcctaggaaatcattcctctcctcacgtaactgtttcttaatcaataattagtccctctggctctatggtgaaaatgaagcatgacacagaattgtgctaagggttttttctttctgttcagataattcacaaaataggcaatttgcattttaataatcataagctaaattaacaggtgatgctgttgtgaaggtaagaatcactattgggaattatatcttggacttcatgatgtgagcaacattttaaggaagtcctcaagccctgggccactgatgtgacgaagcctgtgatgaagatgaaggttgagagcaagacctatggtttctgaatatcctggtttcatgcaggtgtagtgaaagcaataaatccacacatgagtttaacaccttgtttctttcaagtgctttcacagatagtggccacacttgtcaaaatgcttgccttataaacttgctgtgagaaacacattgataatggatctggagacctcaagatgaagctaggcacacagtcatgaattaatggtaattactatgctttacttttgtatgtctctttgactttcgctagctctcttcagtggatcttcagagtaatcttgaaatgctgttaacacccacttaagaggaaataagcacagagtataaaaatggcttgcttgaaggtcatatggctggcaagtggtacaacaaggaccaataatcaaattcactgaaataatgatagagctgataagtatggaacatataagcatgtgtcagatattgcctatgcatatcagttcatttaatcctcacaaataaacctatgagggtaataatagtatcccttttttatagattagggaactgaggttcaaatattaagagaggttaagttatctctatgttgtatcaagttaaacggtaatgaggattaaaatctcgactacagatgatcaagtggctggggggtgggggtgggtatagtgttctaagcctcagcttattaacaatgaaacagtacagtacttatctcaaactgttattctgaggactaaccaagctaagataagtaagctgctgataccatgcctgacatgtactgagcactctttttgttgttaattgtctcactagggcttagtctacgaagacctggtgcctttattgcttaaccagggattagttcactatggtccatgggtcaaatccagcctgaggcctgtttctgtgtggcctatgaggtaagaatgtttttaaattttcaaaggattgtaaaaaacaaagcagaatatgcaacagaggcctgtgtggcttgcaaaccctaaaatcttcactatctggtcttttatagaaaaagtttgccaaaccatagactatccatgctgttttttcaaccttgtgatgcagaactaaaagagacagaaagcctatattgatttagtctaaaaatgcagagctcaacttagagatcttggaagatagaggagtgaatgaaagaagtagaagaaaactgtgtttggtgtttttcagtgaagtgaataagactacatgagatagtagatattctctgccgttgctgttgcacctttctgtaagcaattaaagtataagtaactatagggaagttttttttttaataggggatattgctccctgtcatgccacgtaatctcttaccatttttaggagacattctagtaaagattattataaatttttgaaagtggatttgtgttttctttagggtgctgcactgtatagaaataggccatgaggcagcccaactttattagggttagatatgtatcttctcaaaactatcctgcctgaagcagattttaagtttctaccattcacatctttctatgataaaaatgggtgtttgggagacagcatttatcttcatgaaaaatacacataataatgttacagcgaagtcattgtgctggagagctcagggcagccttccatttggctgaccctgaaggcaacagttaccctgaggttcaaggctactagcctcctttctaggtcaaaaataaggaggggcaagaagcacttaagacagataacctgatagccactctgagatttatcctggttttaacaaaaatatgttaggaagagagtaaagagcccacacatattaaagcaaacaagtgcttccaagactcccatgaaactttaattaatggcacatgtatacatatgtaacaaacctgtacattgtgcacatgtaccctataacttaaagtataatttaaaaaaaagaaaagttataaatgaaaaaaaaaataaaaaacatgaatctcctggaaatgtttcttggttggcccactgcagaggtaaggtgtgtgagaaagacaagcagtgatctgtatcagggagagaggggaggccagagggcatgtgagccaagcctacaaattcatacagggccataaaaagtgcaggtgactctgggactacatacaggaggtgctactgcaaagaagtgaccagcctggggtcatcgaacagagaatgtagaggaggcaagatggataattatggagtcaaagaaaaaaagtccaatgtctaaaccaatggtgagacttcagggggttctttaaatggatgcctgcacaaaaataaataatgagcatgcactatatctacacttatttatggattattttcaatgaataattttattttattcttaaaattcatgtagggagaaggaatcaagttctccatttcagaaattagaaaagtttcaaaaagggaaaggaagtatatccattaagctcctctgatggacattcagggactccgtagacatttccacattccctcatataagcatcgcaagaagccagtttgcttattaccatgtatttaggtgttattgttgtcttttaacatatgaaaaagttgtgactgagaagtttagtcgagatcccacacaattagcaagctctaaagttggaatttgagccctatgtctggctataaccttgacctctttccattatacaatccttccttctctatgtaggattatcctaccttcagaaataaggagacaaaggtttgcacaggaatgaggtttgctgtctccaagtctcttgttctttctagagatcaagctgcttccacttttttcctcaggttatacgatgggcctgtcaacagattgatctccttattgatccctgaatatagtcccattaacctgtggaccactgtacatgttgctccccttgccacagataacctgacctgttatttacatttttcaagtcaaacttgagcatcagctcctcctggaagtcttccctcacccctttttcactgtgacaaccatcatggctccccacggatgccctccagtttataaagatgcctgtcctgtgggttcccataataccttatcatctccctacaagcaaataccacagtacattgtaagagccagattgcatatgtatttcttttattttaccatatattctttgaaggcaggggctgtgctcactgtttccccgggctccagcatggtccctgactactggtggtaagttagtatctgttaaaagaatgagtagatgaaagctttgtttacctttttaataatttttaggctacaattttgaatagtagatcaaagaaatacaaacaggaatgttcattattttattatttatccaatgatactggagtaggagaagcttcagacagagggatttgatatggaacttgcaactcaggtaggaaacaaaagttcacacaaaagggaaatggatacacttagttgcaatgactttaaggaaaaggcagagaaagagacctcccacctgtcctgttgacttttatcagcttttactttgttttgatactgagctaatcaaattagtatctatttccacttctatgtgcaaaaaagcttatttctaagggattaaaacatttcctaaaaatattcagaatagatacttatagtaaaaactaaaacaaaaaaaaaaaaacccttaacacaacacataataagtatctgtctcttatgaggacaaccaccaaaaataacatgcacatcccaaagggctgcttcctcgttacattaatacatcaaaatatctacttatgatgattgatttgtagatgttgatgctgaaaacccatttatcatttgcactgcaatttgcccatctttacagatcataaaaattcattgaattatgcttcttcttatactataatttaatatcttgttttcagcaccagaataaatccccataagtaataatttccctatgttaccctttagcagtcagtcccaatcaatgcattttatatacacacatgcatatgaaaagttaatgaaacaagtttctcacttcataatttcttaactggaacccaaaccaaaagacacagagagaagtacctacctatttaggaatcagaacaacaaaattacccagttaataagaaagtcagctgcatatttctaaaataagtataacatcttgctcattccaccaaaactgtaatttataaccaacactgtggaaaagacacatgtatgtattttcttagaagttcacagtagagatttttagtacagccattctacgccttagacactaacaagacaattaataaaatgatgtaacactggagatctggaataaatgtatgacttttgcattattagtacacatgacattatcttaccttattttcacatcatttctacaaaatgctctaagtattttaataattaatatgtactttttcaatcttttagagaaagtgaggcatggagaagttcagataatgcctcaaaaatatgaatgagatagtgaaaacgcaaaatgaaaataagataacagaccaatcccatcctctaatgcaaaactctctatttttattgtaaaattatgaaaatccccaattatttttagcctctgaagaaatttgctaattgttctcagacatccaaagctaggtcaagaacaagactctttttccccctcaagtcataaacttgtctaaaataaagtaaaacaaagacttaagaaataagaccctcaagtactaaagtgcttttgaacttcaatcgtatattagcaagttattctgaagtatataaccaagatcctggatctccaaaaatctcaagttgtgaatacctctatagcacatcatttctcccataaaatgtaggaaaatacaaaataataattcagtgaaccctttaggaccttaatgattctacaaatacattaataaaatcatttaaaaatctataaaaataaattctgcttcccaaataaacacaacaccccattatgcttccacattactgttgtgacattattgtgaagttactggaatctttaaagaaacttttaatctccattaattattgatctctaaacaatgaataatggatgacttccaaagcttattgagatgaagaaggtgggcagtccacctgggctactccctggccaaagagattggccagatcacactgtgtgtttccagtctatgcctcagtggtattatactcatcacacaatatgactctttagggtactttgtcaataggaaacaccatgagtgttgcatactgcctggaagagctccctttaactggtttggagaacagctgtcaaagccatttcatggattgacaattctttaccagactttcatggtccaggggagctattggggttttgtctgctatgttgatgtaatgataaacttttcaaaaagatccttttacatcctcacaaattctgtttcagagaactttctctaaaatgtattgatctcttggctctattgacttataataattagtcatatgataaacaaccagcggctggagaatggtgggccataaaccagatttgctttcaacatctggtcatggaaggagaagagtgacacttgaagaggtaagaaaggtgagggtgagctgacttaaaggttcaaagcaaaaagatgaaaaaaagactgcctttatgtataaaaatttccatcacacagagagcgtcctttgttcttaggggtgatgccatattgcaacttttatcccatgtaattggtaaggtaatgagatggccaaagagagatgatgctgaaggcacatactataaaatcgctgatgaacagagaccacagattttggtctctgtctctgtacaaggaagtagcacctgatattatttctattgactgctccagtattacactagcagttcctacagaaggaagtatgaactcatgatgggcagattactctattctgtccctttgttcccaactagctatactgaaaaaagaaaatggggtagaaaattataaaatatttaaataaaattggggctaaatatggggctaaaattataaaatatcacaataaaaatttcataaaatttggaatattaaaatgctaatgccatgtgcttctactcagatttagcaaatgttaacacttaccattctttcaacaaatctctctttgtgagaaaaaggcaaatgtagtggaagatcaattttcatcacttttaagcatttttttccctctttccctagaggtaatcaaggtcccaaagctgttttatatcctttctgattgttgtttgtatatttttatcacctatctgcatctccacataacacatagcatttgagttttaaaaagttttacataaatgtaatcatatagtatttatgctgcaatttgctttttcacacaagattggttgagatttttcagtgttgataaggaaaaatctagctcattcaagttcaataatatattcctgtataaatacatcttctaaaaaatgtcattgtgattcttggaccctcttggaattttaattagaatattactaagttgattaatctgagattaatgtcttcattatattaactttagccagtcgtgcacattgtgattctttctctttcatccaatcttttagatccttgaattgcacgttataattttttgattgttgttaaagccattttacacatattatgtacatagttagaggttccttgtagtcattattatcaatggaaatttttttcctattatattctctattttgttatggctgatatgtaaaaacactctcaagtttttatattgatctgatgtgcaataaaccttttaaacacccttctaacagtttggctggaaattcattttcaaatatctatataatcatatcatattcaaatagtgacaattttttttcttcttttccaatcaacctatagtttatattcttctcttttctttccagtaacaaatttaagtgctagcagtagccttgaatatcttatatcttactaaatacctgtctttaatggaaaaatttcttacatttcatccataagtaaggtgtttgctagaatgttggtggatactcttcaatagattaagagtatttgatccttaggtcgataagaatttttattatgaataatgctaaaatttagaaatattttttcctacttctattgaagtgattgtgtgattgttttctttaatcaatgtacagaattatactgagagatttttatgaatttttatgatagtggcctatggtcatattcctggaagaaaaagacttaaaaaatagttcaatgtatttataatactctgttggatttaatttgctgatgttttatttacaattttgtatatatgatcacacatgagaatagcttatacttttttttcctcttctgtttttatctcctcttgatgttaagactatattagcctcataaaatgaattgggtagcattctttatttttctattctctgaaacagtttggactatatatgtaccatcacttactcataaatccatttatacctatagttttctaagaaagacattttataatagctactggttcgttttggtttcaaactaagttttcaagcaactttaataatttaatttattaagaaaactatccatctcttaatattttaaatatttggtgtaataaaatgactgatcaaaatagtaccatagttttatctttccactgtatctacagttgcattattttttcattactcattcagtctctcttttttcttaatcagtcttgctaatttattctttaatacaatcagttttatttttcaaagggccagttttacttgtattgatcatctcttctttgttttctatttcattattgcttctttccagaggattcctttgcaaacaaagttctaaaccatttgaggaaaactattacaaagaaagtcgataaaatcaacaattaagatttgactatactccaaatagaataaagatcatagaggaaactgaaagtaaattttaagtgagatggttcagaatacatgcctagataaaaacataagaactatttttattgagaagataacgtattagacaacaatcactagggaatggggtgcgtaaagtatttaatgtataattgtcttttggagggaacagcataggaaaactaaataatttacatattggttaagtatgttaatttaatggagtactctgctagagcttttctaatttcaattttttgtttttttctattactgctatgtgtttgaatcagaagaagggcaatgtcatcttgacaacttacatattgtaagttatagatcctccagtatctttcttttacttaggaaactttgaaagataacctcagtctcaagtgtcatgtagatcttagatacataaagttctttgaacttgctcaattaaaaaaatggaactgaaacatgaatgtattgggcttcctatccaagcttattttttgatcctgcttttgaatacctttccctctttccaaacagaagagctgatgctgctcttgagggcttggcatttttctgcctttctttgtttaaggtttcacctttccctcagttcctcacctaaatactagaccatgagcttctagaggataggaagtgcttcttatctttttgactttggtgcctagtacattgcctggcacagagtactgaagagttatttctctaatagttacaagtgcttccttttgccatttatcttagtctatctcatctctatagatatgaacatagcccttaaagacactacaagtctaaatctcactccttcaagagtcagcctccctctattgtaaagcttttctttatagtgacaactggaaataattcaattttgaaagtttttttttaacgtgtctcttttatgccacttattgttttctataccataagacagtgatttatggacatagattttcttttttacaggactgtaaaccctctaagaccaggatccatctaatttttgttctatacaaagcaaaacaatttataaatatttgatgaataaatactttataacataaaggaaatgatcatgtttgaatttttcacttgtttgccttttaattaatcattattttcaccaggccagtaagaagattgctgaactatggtgctgatgtgtcacctggagagcagatgtcctatgggcatgaaatgttgccttacttccttttaacaagaatcaacccctcaacgttggctttgtagcaaggctacataaaattaccaggcttttagaatacctctaaagcaaaggtcaattataatttgttggataatttctcttctaaatttataattctgagatgtttaattttagagtgataaaaattatgattcaaaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctatatatccaacaaaggacgagtatccaaaatctaaaaagaactcaaatcagcaagaaaaaataaagcaatcctatcaaaaagtgggctaaggacatgaatagactattctcaaaatcagatatataaatggccaagaagcatatggaaaaatgctccacatcactaaatatcagggaaatacaaatcaaaaccacaatgcaataccaccccactcctgctagaatggccataataaaaaaattaaaaaataatagatgttggcatggatgctgtgaaaagggaacacttttacaccgttggtgggaatgtaaacttgtacaaccactatggaaaacagtgtggcgattacttaaagaactaaaagtagatctactgtttaatccatcaatcccacttctcggtatctacctagaggaaaagagttattatagaaaaaagatacttgtgcacacatgtttacagcagcacaatttgcaattgcaaaaatatggaactaacccaaatgcccatcaatcaatgagtggataaagaaaatgtgctgtgtgtgtgtatgtgtatgtacatacacatacaccatggaatactactcagccataaaaaggaattaaataatggcattcacagcaacctggatggaagtggagattatcaatctaaggggagtaacctaggaaaggaaaaccaaacatagtatgttctcactcatttgtgagaactaacctatgaggacacaaaggcatagaagatacattggactttggggactgggggaaaatgtgggggatggtgagggataaaagactgcacattgggtacagtttacactacttgggtgatgggtacaccaaaatcccagaaatcaccactaaataacttaaagaatgcctgggattttttatattttgttcaacatgaacttattaatattatttatattagaaaaatgcatgttagtgctgtttcagttagactcagaaaagctgatgtaatccaatcaaaaacttaaatccattctatcagtagatgtatcattaaggtttaaattcaatgagcagggaatgaagtcaagtttcagcaaatttactgtagaaaatgatgataagaagtgtgcaaagtggaatgctacaaacacacaagcagttggcgggggcgggggagggggcacagagacgggatcctgtcctgagtcagctaattaccaacctggggaagttacttagcccttctgagccttactttctatgcctaaaaactgggaattgtattgtggatttgaagaatgtttgttaagaatactgaaatgtatgtacatatgctcctaataccatatttggagcctatcatttatgttataatttatgatcctttatcataatcatttattattatgaggatgatgatgaaaattttccatagtcagcaatcctgggcttcatagccctatgatcagacttgcaaattagaacttgagtttctgctgcgatcaggtaaatgaagtttgtcctgagggtcatgatcatgacagtatgctctggtgcaaataattagggcaatttaaaaaattacattctcaatggtttgggcattaatcttttctaaataatcataataaagtggaatagtccatcttaagaagaagttatagccaaataattttgttcaattatattaaccaatatataaaacatgagatgctttattaaagcaaatgagaaaaaaaatctactttgccaaaagaacatttggatttttttctttactatataccaatgctctgtaacatgggagagctatttcctactttataatgaaaatgtatgtgaaatacacatgcaagacaaggacggcatgtatgataagtgatatgacccaggaagaactacaggagatcatgatacaaacaagggtctatgaactggtggggaagagagagtcataaagaagacagggaccagaaatacatgctaatggagaaatgacttcagcatcatagaagaaataagtaaaaactcagaaatgagaattgtttttcccaggtaactagtctcaagggtatggtggtgaacacagttgtgttttaatgcaatccacagaaaaaatggcagaatagtctgtgaagccaaacagcagtgaaggtgagtgcaaatctgggatgaataagggagggattagccaaggagaccttccacctgggaccccaatatgccatgaactgagctggttatggtagcttgccatttattaggtttaatattaatactaagcaatttactacaatgtctcataatctttacaatgattttgtaatgattatcttgatattacagatgaagaaactgaggggaaaaagatgttaacttttgctgattctttcaaaatctctaattcttacaacaaccttagttcagcattattaaccttattttcaggtaagaaactgaaatttggagacactgagtcacttaacaatggccacacagctgataggtaggagaatcaaagaatgaatatggatctgtgagaaaacacagaatcacatacatgcatctatgaggacttgaggtaacacactgtctcctattatttgaaatggtagaagctgagtctaggtcacatggttatggaatatctattatatgcaaaggtcaaagtttatagaattttagaggtgaaagggcccttagatatcttttattgcaatatgcttactttatacataaggaaatactccaagaaatgtaaatggttcaaagttaaactatgttcagtacgttcagtgattattaatataaagaatggaatcatacacacagaagattctgccccacctacatgggtaattttgtgatgccaaatttaacattttctaattaattgtctacaatttttcaatatcaaataattctctttgtaaaagtagaaaactggagaatgataagtttgaacataaaaaaggaaatggaaatgtgttaattataaaaaaaaaaatgtcctattttaaagttaggtggctgttagcattttttttctgctcaggcttgaccctgagagggcttcctctgctgtagatagggagttaggaaaactattcctatctaaaaatgaaaataccaatgtagcttacttgctggccaaggtgtacatatagacatcaatgtcatgtaacaaattttaacttaaatcctgcaatgagtataagaaaatcctaaattgataaagcaaccattctctgggaaccaggaaaagcaaaaacaaaattgctctatagaaatacttttacaaccatcctcacaaggaacttccacagaaaaagagatatccattgaataacagattcctaaccaaaattagaaacaacaggaggaaataaatcaatgtaggagtagtcagaagctaaaattaaattgataatgtatgctgtaagaatcaaaaataatatatactcttgaaaaagacaacatatttataataaaaatgtaacagaagagatagaaatcacaatcataatgaaagaacaagacctcctatgggaaaaagaaaaatcagatttaaaaagaaaccagaatagactgataaaaatgaaaattataagaataaaattaaaatgcagtgggtgtattaaacaacagctatgattagctaaagagggcattagggaattggaaaacagatgtgaagaagccacatagaattcaacacacagaaacatatagaaaaatttaaaagatgaagagatatggaacatagaaagaaatagattaccatccaagaaacaacttgttagagtatatacttgtggcttgttagtcttcccttatgtcttcgatgatggtatttaattgacttcctgttttgtttttgtgatgtctgagttacttacatattcagaagtagattacagtcatcccacattatccacaggggactggtttcagaaccccactctgataccaaaatctgtagttgctcaagtcctttatataaaataacgtagtatagttgaccctccatagccatagtttccccattcatggagcgcttactgtgctacactgatccaattttgattctgttaattcgtgtaagcatagtacaagtttaactatttattaagtgaatataaatagaactctaggaaactagaggaagcaaagataaatcatgacaaacaaaaatatgatagaaagtggtggaagtatgaccaaatataccagtaatcaggatgaaaattggaattaaacttccatattaaaaataatatcaggtaccatttaaaaataaccttataatgaaaaattataaattcatatgaatttatgaatgaaaaattataaattcttatgaaagaggaaagcaccaagacaagtgtagaaatataaggaatgatgactaatcatgccagctgacatcaggacccatacaagtataagttatagacaactagaccagtggcagaagggaaagcctagaatcacatgcattatgtgcaaagttggaatacgaagaacgtggcattaaaattaatatggacttaagaataggctatttaacaaattttggtaattcaactggctgtgggaaataattggatccctacttcatattaatacaattcaagaatttcatacagataaaataccaaaatgtgaaaagaaaagttataaaatttagagagaagtataatatttttataatcttagcacagaggaggattaaggaaataaggtacaaaatctatcagctatcatggaaaagttagttaagtagataaatgtgacatattaacattttaaatcgtctgtataagcaaagttaaatgcctgagactgggagaagatatttgctgggcacataagtgatataatattagtatccagaactctgtcactttgataaaaaaataggcaaataatataaactaaaaactcacagtagaagatacccaagcaagtaactagatgctcattttcacttgtgattcagagaaatgcgtatttgaaaaacaaagatatctattcacatcagcaaaatcttgcaattaattgggcaaatatgtcaaagaagaaaatggatgaataattgtggtacatttatacaatataatccttaagatcaaataaataaactatacctacatatatgaacatgaatatatttcaaaatataattaaaaaagcagtttgcaaaggacacatatagtatgtgcaataattatgaacacatgtatgtaccaagagtaaaaggtgatgtactaacgtcagtgtagtgatcccttctagtgaccaagaaaacacagaacacaaaaaacaaacaacaaactggaatgaagaagtatatagacgtataatgacactttttctaagaacaaaacctctgagacaatacttgattattttttgttgctgccatttgtctttggaactgacatcatgccggggttgggtcatgaagctgatgacttgatgtaagttgcatggatgttgttagtttcctcttcaattgccttttagctccttaaaagcaaatggaatttgtccccaatagtatattttcaatgactgatacaatttataaaatgtgagttgtcaacaaggagcatgatgaggagaacactgaaaatatgaacaaatcctaagaaagttaatagctagatcttgaatgaacttgagaggaagttatccaaattgaaaactaaggcttaaggaggaaggcaattgccagaggccaagtgactgatgagaagtaaggatttacaagccacaggtctccagctatttcttctaagcctgtggtacataaagttctttgtgtcagagacttccttgagagtctgaaggaagcttaaagtctcaatttcaccatttcttcaagaaatgagcacatatttgcaaaatttgcatataatttctgaagcctaaggtctgaaaccttacctaagaacatccactgttaagaatttctgtggacaagtcctaggctacatgttgttggcataggatctaattgggaatgctgctttttatttaaacaaatcagatattctttcaggtcaaccacgttggatgtggggaggatcatttttagaatgggagctcctcagagatggtagtttccaggtgagtggaagtagacatcagagttccaggtgagtagaggtagacattggagtctacttctgctcaccttggagtagacattggagaagggtgggatggatggaaaaggagaatcctttgggagaggcattggagtttgctgccatagcttgatctaagagctttgacaggctggggctttcagacaccaggattcaaagcagctcagagcatctccatgcaaagcatccagagtgctttgtagccatcctttcccataatacaggcaatctttctgttcttaattgcacaatttgtcctaagaaattagaagaaacaaagaaaagccttacaactacatgagagagattaactttttaaggaaggaccacacccaccatttcattaactctatatttccagtgcattgcagattgctgggaatttcaatcaccactcggtaaatgtattcattgcattgattgcaaaaagctaatttgatttgctttggatgtttctcctcctccaaatctcatgttgaaatgtgacctccaatgttggggtctagtgggaggtgtttgagtcatgggggtggatcctcataaatgtcttggtactgtcctcaaggtaatgagtgagttctcactctgagtgcatgtgagacctgactgtttaaaagaccctggggccagatgtggtggctcaaacttgtaatctcagaactttgagaggctgaggtggatagatcactttaggtcagaggttcaagactagcctggctaacatagtgaaaccctgtctctactaaaaatacaaaaattatccaagtgtggtggcacatgcctgtaatcccagctactcaggaggctgaggtgggagacttgcttgaaaccagtaggtggaggttgcagtgagccgatactgtgccactgccctccagcctaggtgatagaatgaggctccatctcaaaataaataaattaattaaaataaaataacctggcactttcttccttgctctcttgctccctttctcaccatttgaccagcttctcctttgtcttccaacatgattggaagattcttgaggctctcgctagaagcagatgctggtgagatgctttctgtacattccgcagaactgtgagcaaaataaacctcttttctttataaattacccaatttcaaatattcctttatagccatgcaaagcagactaccacagaaaattcatactgtggtatggagcactgctataaagatacctgaaaatgtggaagcagctttgggacttggtaactgacaaatgttggaagagtttgaatgtctcagaggaaggcaggaagaaagatgaaggaaagtttggaaattcctagagacttgttaagtggttgtgaccaaaatgctgatagaaacattggcagtgaaggccaggctaattaagtctcatatgaaaatgaggaagttattgggatctggaataaagtttacccatgttgtgtgctagcaaataacttagctgcactgtgtccatgtcctagggatccgtggaagtttgaacttaagagggatgacttagggtatctggtagaagaaaatttctaagcagtagtattgaagatgtggcatggctgcttctaacagcctacagttaattagacgcacatgcaaaggcataacttaaagtttgaatttacaataaaaaggactgcagggtgtaaaaatctggaaaatttacagcctggccacatagtagagaaggaaagaccattttcaggagaatagaccaagcaggctgtggagcaaccacttgctagagacattcacatgactaaatggtagtcatgcactcgtagccaagacaacgggataaagacctcaaaggcatttcacaagtttctgaggcaggtctcccaccacaggcccagaggcttggaaaggaagaatggtttcatgagccagaactggggcattgctccccacttcctggctgcggctcaaggcatcccaggtacaactccagccagatgcttcagatagcacaagttgtaagccttttcagcttccacatagtgcaaagcctttaggccctcagaacccaagagtgaaggaggcttggcagcttccacccagatttcagaggatgtatgggaaagcctgggtactcagacagaagcctgcttcagaggaagagccctcagaaagagcctttgctagggcagtatagaggggaagtgtggggttggagcccccatacaaagtccccaccagcacactgcctagtggagctgtaggaagggtcatgctgcccttcagaccaaataatggtagagccactgacagcttatgccctcagtctgaaaaagccacaggcaatagactccaacctgtgagagcagccgtgggggctgtaccctgcaaagccatagggacaggccagcccaaagtcttaggaggccatccctcatacccatgttcccaggatgcaagaagcagagccaaaggagattatggtggagatttaagatttaatgtctgctctgctgtgtttcagacttgcatggggcttgttactcctctcttttggccaatttatcccttttgaaatagaaatgtttactcaatgcctgtaccaccattatatctaggaaataaataacttatttttgatttgacaatctcgtaggtagaagaagcttgccttgagtgtcagatgagactttagacttttgagtgatgctggaatgagttaagattttggaggactattgggaaaggatgattgtattttggaatgtgagatgaacatgaaatttggaggaccagggaagaagtaatatggtatggatattttgccatttccaaatctcatgttcaaatgtgacttccagtattacaggtggacctagtgggaggtgtttgggtcacgggggtagatccctcatgaatggcttggtgctgtccccatgataatgagtgagttctcactctatgagttcacatgatatctggttgtttaaaagagaccgacactccttcctctatctcttgcttgctctctcaccatgtgacatgcttgctcccactttccttccaccatgattggaagcttctgggggccatcaccacaaggagattctaatgccatgcttcctgtacacccagcagagctatgagacaaataaacctcttttctttataaattacaaaattccaggtgttcctttatagcagcacaaaacagacacacataattctaggttctttttacaaacaccaagattcagacattttagtggtttaaaattagggtaaagagtctcattgccattattctctttaatgaacaaaacgttagttgtgaaattatatattttaatgaaatatagtgtagccatttacattaatttgtacattgtaaacatgttaatgtttctctgtattgtctcttccaccaaaaatgttatctttgactgattcaccctctccgaatactgggagagaagggttattttggtttggttttaatttgtcaatcccacaagcagttttcagcagatagaaggtatttggagattttcttacatgaaacaatccaagcatacactttataattttttttactatgtttaaattgatgtatacaacacatgcagaaaagtacacagatgataagtatataatctgattcatttctacaaagtaaatacatctatgtgtttgccaccaaaaatctaggtcctacactaaaaaatagaacattaccagcatcccagaagccccagatcaaagtaggcatatgcaagaaatattttgtaatttccaatgtaattgcttctttgatccatgggttatttagaaatacgttgcctaattttccaacatttgggaatacatttgggaatttcctagttacattcctgttatttacttacagtgtaatatcactgtgaagagatatatatacatatatatatgtatatgtatatatacaatctgctttgtgttttctggattaaaaaaagtttgttatatcagttgttgagaattgttacagtctcctactataattatagattgctctattcttcacttagttttgtcaatttttgctttactgaaattaagtctatgatttaaggtgaatacaaatttagaactgttatatctttttagtggattgacccttttatcattataaaatatcctgtttaccgctggtaatattttttgccttaaatctacattacctcatattaaacaatttggatgatatattttcagatatttttggcatttcctgaacaatgcaagcttcttagaagcttcaaatccaatgataccctctccatattttatatcattgttttgggggggtggtattttaattctgcataaattttaaactcaaaacaatattagtagcatcatattttaatatcactttatagggtcaatattaatttatatgtctactttttcctcattactttctgaattttcttgcttcaatctaggatcatttttctttgcctaaagaattcacttgtattttgttttctgcaaatccgtcattttttgtctaaaaatgtctttattttgtctttacactgaaaggataattttacttggtatagaatttcaaaattgctgtaatttgctttaattcttaaaaaatgtcactccatttattctgccttccataacttttattcaacttctattttagattcagggggtacataagtaggtttgttacatggatatattgcatgatgctgatgtttggggcatgattgattccatcacccaggtagtaaacatagtacccaataaatagtttttcaacccttgccccatccttctttaccccctccagtgtccctagttctattgttgccatctttatgcccatgtgtacctaatgtttagctaccatgtatgtgtacatgtagtatttgggtttctgcttttgtgttagtttgcttagtataatggcctccagcatcactcattgttgctgcaaaagacaggattttgttctttttttattggtgtagagttttacatggtttgtatgtaccacattttatttatccagtctaccattgatgggtatcgaggttgattccatataacaaacctactcatgtaccccctgaatctaaaataaaagttgaataaaagttatggaaggcagaataaatggaatggcattttttaagaattaaagcgaatcacagaaattttgaaattctacaccaatcatgggcattgaggttgattccatgtctttgccattttgaataccactccaatgaacatctgagtataggtttctttttgggaaaaatgatttattttcctttggagatatacccagcaatgggattgcttggttgaatagtagttccatctttagtcctttgagaaatcttcaaactgctttccacagtagttgaactaatttatattcccaccaacagtgtataagcattctcttatctctgcagccttgccaatatctgttatttttctttttttaatagccattctgacttgagatgatatctcattgtaactttgatttgcatttctctgataattagtaatgttgtatgtcttcttttcagaactgaacaaaataaagatctatacaggaaaaccaaagtttattttttgtaaggataaaaaagatcaatagactactagctagattaacaaaggaaaaaagggagaagattcaaataagcactatcagaaacaacaaagatgacattacaaccaatcccacagaaacacaaaagttactcagagattattatgaacacctctatgcacacaaacagaaaatctagagaaaatggataaattcccaggaatgcacaaccttcaaatattcaatcaggaagaaatagaaaccctgaacagaacaataacatgtgccagaattgaatcagtcattttaaaagactaccaaccaaaaaaggcccaggaccaggtggattcacagccaaattctaccagacatatgaagaagagctggtaccaatccttactgaaactattctagaaaataaaggaggaggactgcttctcagccctttggctaagatcaagtgaaaatcaaggaggagagactcctccctaattcatttgatgaaatcagcatcagctcaacattaaagcccagcaaagacatgataaaaaaagaaaactacaaactactatccctgaagaacacagatatgaaaatcctcaacaaatactagcaagctgaaatccagcatcacatcaaagtgttaattcaccacaatcaagcaggtgttattcctgggatgcaaggttggttcaacatccataaatcagtaaatgtgattcacgacatgaacagaattaaaaacataaatcatatgatcatcttgatagacacagaaagatttcagtaaaatccaacatcccttcatgataaaaaccctcaacaaagtaggcattgaaggaatgtatctcaaaattattggcaccatctgtgacaaacccacagccaacaccataatgagtgggtgaaagctagaacaattcccctattctccttaataactagaacaagacaaggatgccattctaaccactcctattctactgagtactagaactcctagccagacaaatcaggcaagagaaagaaataaaatgcatccaaataggaaaaaaagtcaaattatctttctttgctgatgacatgattttatatctagacaaccctaaagactccatttaaaggctcctaaaactgataaacaacttcaataaagtttcaagatacaaaataaaagtacaaaaatcagtactatttctatacactgataatattcaacctgagagccaaattaagaacaaaatcctatttacaatagcaacaacaacaaaaaaatacctaggaatacatctagccaagggggtgaaaattttctgcaaggagaactaccaaacactgctgaaagaaatcaaagatgacacaaacaaatggagaaacattccatgctcatatattggaagaatcaatatcattaaaatgaatatactgcccaaagcaatctacagatttgatgttattccttgcaaactgccaatgtcttttttcacagaattggaaatatcaatcctaaaattcatatggaacttgaaaagagcccaaatggctaaacgatcctaagcaaaaataaaagtcagacttcatcacattacccaacttcaaactatataacaaggctacagtaaccaaaacagcaatggtaccagtataaaaacaggctcatacaccaatggaacaaaatagagagcccagaaataaacccatatccctacaaccaatcaaccaaccaactgatctttgacaaagtcaacaaaaataagcaatgaggaaaggactttctattcaataaatggtgctgggataactggctgtgcatatgcagaatgaaactaaacctctatctttcactgtaaacaaaaataaactcaagatggattaaagatttaaatgtaagacctaaaactataaaaatcctagaagaaaacctaagaaataccctaatggacatggccttagcaaagaattttgactaagtcctcaagaacaattgcaacaaaaaaacctccaacatttacaaatgggatgtgattcaactaatgagtttctgcacagcaaaagaaactgtcaacaaagtaaacagacagcttacagaatggcaaaaaaaaaaacttgcaaagtatgcatgcaacaaaggcctactatccagaatgtagacagaacttaaacaatccaacaagcaaaaaaaatgaccccattaaaaagtgggcaacagacataatttgtgttgaatgaagtctgcattttatgtctttttctttaaaggttaaatgtctcttttttcttctgtctatatttaaaatttttacttttatcttttaacagttttactatgttttacctatgtgtagttttattttattttattcttgttggggtttgtcaagtttattgtttctgtgggttagtgtttatcagttttagaaaattctcaaccattatctcagcgaacatgactcctaccttattctgcacttcccttctatctgggctcttggctgcttagggcttcataacctcagttactctaaaatcccttctgggatatttttaaatcattttatgcacattatctggttctctgcaaaaggatcaatctgatctaagctaatcctccatagccagaaggagaacatccccgtttgaggtgatacttcttatactgtcataatcctagccatagactgaacacataatatacttatttttacttagacatagtcacatatgtgaaatgtgagccaaatttaagttatgtaaaaagataataatgttgagcctattaagtaacattaagatctgcagtcctagtcaccagttgccctaagtgagagtactagggcaatgtgacctcactataaacccgtgcatgcttgaggggctgccaaatcacaagctggagtcagtggggggtgggagggggtaaagctactgccagaaatcccaagccaaagggaagcagaggaagggagccaggtgaaggaagtagcagcgtggcatattgtgtattggaagatatccagaagcactttggggccctcacaggctacttcctcatccacagatgatacccaggcctccctctaaaagcagataactttttgtgtctaagcttcagatttcttaaaatgataatcatgaataattatattacaggctggtaatgactgtaaataataaatatgcaaagtgcttagaatagtgtcttattcagggtaattgcttaataagtcagctatgataatggtgatagtgataataattattgtgtttaagatattgatgattgtgatgatggtcataaagtaaaaatgattatcattaccatgaagaaagaggatatcatatatatagtatatgtatatatacactcccccaaaaagtcagctatgacatgacagaatgctagacttccccttttaccttgaccttaatatacagtaagtatgtatgcttgaaccatcccaaaaccttccctcccaacccctggtccatggaaaaaaatgtcttaaatatacatacatactgtatattaaggtcaaggtaaaaagggaagtctgatatttactgcttttaaatatgttttctactgtaaagtggtcatgcttctgagcctctatctgattgaactggctgagttctatatcagggcaccagtgccctaaacagggtctctgtgacataggacatgcctccacctgggttctactccactttccctcatacaagtaatgtcaaggagagaataaagctaacttattgtcatagagcttgaagaaggacttcacactagtttttatagctcagagtttcaggatgattaataagcaaggactccaaggagaaacagcacatacttcagaagagacacattcctcattgtggctcttgctggaaaatattgataatagaaagcaattttcccaaggttcattcacataggactagatggattttttgcttcaagttcactgcatttttagaagggaataattaaaaaaaaatctaagtgccacttaaaccaaatgggtaaagcacctagatagaaaatgataaaatcaggacactgccatttctattcatgaatgccttttctgtcttcatttaacttaagatatttttgattgtagagaagtaaaacatgcataaaataccagccttttcagcaagtgataggcaactttgttgatacaaatggatttgatgattacttttcaagctgtagataaagacagaattgatggtgacagggaagagatggaacccatatgggaaaggctgaggaaataaacttgtccaggatgtatttctatgcttttttatgtacaaagaaatatacaaacatagaaatatatatatacacatagtatatatgtataatgtgtatattacatataaatatatatatctgtgtgtacacatacatgtacacacagaaggaaaatatcttttaaattgagagaagaataacagttttcccctaatctggctgaggttaagattctagcaaatatgggctcccattcataagtaaacttgtcccagtgaagacagaggaaattgtctaagaaagccaaagggtcttccactgaggtggaacagagtgacatgggttaggggccccatgcagctgaggattcttcatcaaagtgagttgtgcaataaatgtgcactagagtaaaattacgtaagcctcaaagtctcctctgaaccaccactgtctttccagacttgaggaatctcactttcctctctcatacaactcccatggttctctactcaatagcatctactatgtccctttttttctagtttaatcctcccagagacctagagttttcaaagacagaggcagatgatgggagaaaacgtcctagagcagcggttcccaactgtattggtctgttctcatgctgctaacaaagacatacccaggactgggtaatttataaaggaaagaggtttcattgagtcatagtttagcatggctggggaggcctcagaaaactaacaatcatggcagaaggggaagcaaacagatccttcttcatgtggtagcaacaaggagaagtgccaaacaagagggggaaaagccctttataaaaccctgagatttcaagagagctcactattatgagaacagcagcatgggggtaacgacccctatgattcaattacctctcatgggctccttcccacaacatatggggattatgggaactacaattcaataggagatttgggcggggacacagccaaaccatatcatcaacatttctggcacgaggaaccagttttgtggaagacaatatttctgtggacctggggtgggggttggggcaaaggtttcaggatgattcaagtgcatcacatttattgtgtgcttgatttctattattacattgtaatatttaaataattatacaacctcaccataatgtagaatcaatgggagtcctgagtttgttttcctggaactagatggtcccatctaggggcgatgggagatagtgacaggtcatcaggcattagattatcataaggagcatgcaacctagatccctcacatgtgcagttcacaatagggtttgacctcctgtgagaatctaatgcagctactgatcaagaagagccagagctcaggtggtaatgtgagtcatggggagtggctgtaaatgcagatgaagcttccctcactcacctgttgctgctcacttcctgctgtgcggcccagttcctaacaggcctctgactggtatgggggtagagggtgggggtgttggagacccctctcctagaggaaaggaaatgcaacagactggctttcttcttggaatcccctcatcagttctcagttttctcatctataataagaggagtttgaactataattatctgaagtctgccccagctggttactctgggagtctaggatctaaaattggggaaagacgacatgcacatagaaattacattttaaaaatctatatagtgtaggaaagaaggaagccctgaggctgaagcagtgactatgcaactctccttacagaagccatgttcaggagacctcattcccttttgcagaccctcattcacttttttcccctcacccctactcagaatcagagctaatttttcttaggaaagaaactctttccagaagtgaggcagatacaatgctttgcatttttcagatgagaaagctgtgagtcacagttgagtaatttgtccacagtgacacagtgtatctaataagtggtagagagaaacaagtaggagacagagacagtcatttgacagaatctcccttcccttgaacccttgtgtcaagagcttctgggatcctactttcaacactggtaggctggactgcttttggctgaggtgagttctctctaaagccatcttgctgaccatcactttatattggctgacctctcagtttcctctctgtaaatacaagcagcaatatctgagtccatgcctcccagggatagtaagataaatgagataataaaggtgagaaccaaatgagctcctcttaatgatggtgttaaaaaccccatgaggtactgtgatgttattaacaaaatgcagaggctgcagagttacatttggccaaattcttacacctctcaattttttagcaaggagacatagatatgaaatcagtattcccaatagtgaaactgactacaagtgtgttctcatttttaaacaaacctattctatgcaaatccaattaatagaaaaagtataccaatcaaggatctatacatatagctatctttcacaaaactattctagttttccttattaaaaaacttcaaaacacttcatgctttgtggcatttcagtgaaattggaattgtaaaataatgatttactgaaaaccttttaaaggtactgatctggcatgaagtgaggtacgactgaagtttctagacaaccatttgagattttggctgtggagccctcccaaaagaagattctaccagccagttgcatcacttgcaaatattggaggccgttgctctggaaaagcaactaaaaataatacctgggtgtggacaaaataagaagggagccatactcagctatgagccagtgtattgcaaagggccagtgctggtcaaaagcagtggggccatcatcttgatttagacatactgtccacttctctaatgcaaacccacaaaattgttgactcttagagtgcccacaaagcttctgctgtgacgataggacttttagggccatgaagaagctaacactaacttttacatttcaatttttaccttttcccacatagcttacgctaaaactcttcccaacttgtggcctggagaatgtatttttctggcattacattccctttccaacattattcctgtccctcaacctgttcagtaatcttatctaaaactactggataattcctttgagggtgctatcatagcccaaatatgtcaaggtctgtttttcactagtaaacagtgaacatcttcagttttaaatgataagttaattctacaacttaattgagcccatttatgtttattcattgctgaagttcctcttagatcttgccttctctcacatcttctctataacccaagaaggaacccacctagatctcctggaccccctcttgcctgatttaggtagatcatcataggagatgaaaaattatcatctcaaatttaagttttcaagagatggtatcaaaacacgcttttgtcaacaagcccaatcatattcccacaacttttgagtgctcttcctgattctagagcaaacacactgatttagatagagcaccatgtttctgaaccttgaataatcctgttcagattgaagcaggggtgtattaatagagcgcaggtcttggagttaaaccacacccgccctcacccccaaccccaccaccccacaacaggcttaggaaggttgctcaacctctcaaggcgaaggcgtttgctgtttctcatctgtaaaacaccaaagattgccatccccatcactgttgtggaagatcagcgagacataaagtgcctgtcaggatgtttggccaatagtggtacctgattcagtcattcagtgactttcacagtcaccttgagcttgactctctcaagaaaagaaaagaaattaagaagcatgtgagccattgaaccttgaccacaaatattctaagaaacttataactccttagccatatgtttcatttcaaatccaagtatgaaaaaagctatgtaactgaactaaaaagtggatctactctataatttattgtattataatacatatgtatacatctcacacactgtgtatttatactttaagagagaaagacttttataagactttttacgtcaagtgagggcatctgttcatttctgtagagcacatactgctttgctgcagagtgcagagagaatgactttgctcttcataccctaaaattgagtccaccagggatgaaacataggcgtgtagtagcaaaggcttctgtccagctgagcagtaaatcctggctgcccctgatgatcacagggactggctcctggtaataattttgatgtcattatcctctcctagaaatgcatgaatggttctggcctttaaaaacagatttaagaggatgcatttatcttgaccttatcagccttttaaagatcatgccgtagggcctgttgacctttctctcttaacgatgagttgcaaaacagtgggataacatcaatggatgaaagggagaaagagtgtgtaaccagaagcagcacccatggagaggaggaggtgggacagggatgttcaggctgacaaaggaaacttgctttagtcctgtgggaattgaagaatcccacataaatggaagcacaggaggcacaaatgggattccatttccatctctgctctaaatatgcagtccttgggtactgtgatggttaattttaggtttcaacttcactggaataagcaatacctagaaacttggtaaagcattatttttaggtgtctgtgaggggtttttccaaggagattagcatgtgggtctgagtaaaataggtggggaagatctgcctttgatatgaggaggcaccattcattcttccaagtccagaaaaggcaaatgtgtcaatctatctgctgaaactgggatacactcttcctctcttgttcttggacaaaaacttcaggctcccagcctttgggctccagaatttatagcagcaacccctttccccacctgaggctctcaggtctttggtcatggaatggggattgtcataagcttccttagatctaaggccttcagtcttggactgagccacactactggcatcccagggtatccagcttgaggatatcatgggacttctcagccttgataattacatgagccaatgcttttaataaatctcttctcatttatccatacatattttattgattctgcctctctggagaaccctaatagaggtatacatcaaggcataagtcaagaaaaataagatatttggcttattaagtggttggcaatgacttcaactcttttttttttttttgagatggagtctcactctcgtgcaggctggagtgcagtggcatgatctcagctcactgctacctccgcctcctgggttcaagcaattctcatgcctcagcctcccaagtagctgagactacaggcatgcaccaccatgcctggcgaatttttgtatttttagtagagatggggttttgcattgttagccaggctggtcttaaactcctgacctcaagtgatccacccacctcggcctcccaaagtgctgggattacaggtgtgagccactgtgcctggctgtgactccaactctccaacgggtaaagcacaaacacatttacttaactgcacccaatcttgtgaattttgacacttttaaattataggtagtgttcaccaattcaccactgtataataggaataacatgggattctgtgactgttcatgtaaaggattcatataaagctctatcattttctagtagagtttcccaaaatattttttaaaaatatcaagggtttctaacatctcaaggattaaagacaataataagtaaagagttcttcacacagttctttggtgatgccatgtgtttaattaatgctaatatcttctcccattccgccaaatttccctttgcaataagttgctcaatcgataaatcaaatgatgaaaaaaagatacagttgataaaaattagaaattgagaatgtctggcttccctgaaagttttgagatctagttaccgtgaccacatatttagggcaatacagaattttaacagagggaccaaaatttgaaattgaaagcactctgaaaaaatacaagagctgccatgagcacagtaaagatctctaatacacacaaataaaaatcgagtaagttaaaagcaccggcttttctgccctctcaacccaaggaggtcatatcaatgcacaaactaaaatgcacaattctatgcttacccactatcactacagcccagtgaatgctttaaatcccagacatggttaaaaatatagctggttatgtgattttctattaaacctaatatagtgggatgaaccataataccttacaggagcagatgaactagtatttccaaggcaaccaaaggatatcaatatcactttattattattattattattttcattctgcaaggaatcttccttgaagagcaattccttttatgcattggtctgcttgatagctttctgaataactgtaatccataaggctttgtacctctttttgcatgctggaaacactctgacttaatctaattatctcatgaaacttcactcttaaataaagcttgaagtaaaattagaaagcagcctctttcttttcctttagttactgtcttcatggtaccttcctcttggccggttgctcataagaaaatgggctatgcctctgcagagaaagcattctttacacttctctctggcaaggagaagttgggtttgggccaagtcgggccccatgaaaagagaataaaatatgactggaaaccttccttctgcatgacaaaggagtggctggctagaagcaaacatttattgagcaaatattggaagtcaggcacgttgaaaatatcactggtctaagagatctcagatttgccagggagaaaaatgggccaacatgggatgtcaatatactccaataaagcctataagggtcagcattgattcattatccaaacagtgtgacatttgagaatgaaaggggagcatcaaaaattctgcaaggacaactgacataaacattatcctaattaggatctaaatgtcttgaaacacaaaggagaaccctaattgaagtatacgtcaaggcatgagtcaagagaactaagatttttggcttactaagtggttggcaatgactccaactacaacatggatttggaggaaggtgggccaccagaggtttcagagaaatttttgcgttgggtcatgaaggaaaaatagatgttgttaagtggagaatcagaagaatgtttcatacaaaatgaaagagcaaggacaaagatatagagtagtaaaattggatactgtggctcataccaatttgaacccagagaaaacaattagaagatttcatttttccccttcatattgaaaaaatacaaaagactgacaatgccaagtactcataaaggcataggttaatactccatgtataggtagaactaatttggagaatatcaccgaagtgtctaataaaattgaagatgcatatgccctataatccggaagtcaaattcctgatataaacccacatgtgtatccaagaataaaaaagaacattcattgcatattgtttatcatagcgaaaaattagaaataagttttcatgaagtgcagaatggaaaaataaattgtagtaaatccatttaatagggtactattcagcagttaaatgaactaaaacccaatggatctatcaaaataaataagtctcaacaaacatattaagtggaaaaagaaaacaagctacagaaagatatgttctataagataccataacaataaagattaacagcatggaaatagtactacaaactgtttaatgtatacattaaaaggcttgcatggctactgtacataatgctgcaatgaacatgcaagtgaaaatatctcttttgatcaattatatacaatagggtttgcactcctaagagattattcagcttttaaaaagaagaaaatcctgccatttgccacaacatgaatgatcctagaagacattatgctaagtgaaacaagccagatacaaaaatacaaatattgcgtgatatcacttatatgtgaaatctaaactagtcaaactcatagaagcagagtgaaatggtggttgacaaaaattcaggaaggggtaagtgaggaggtattagtcaagggtacaaagcactttatccgcacttggaatatacaagtcctagaaatctacagtacaggatagtgcctatagttaacagtattgtattgtatacttaaatatttgctaagatggtagatcttatgtaaaattttcttatcacacacaaaatagtagaaataataaagagagcagaaagaaacttctggaggtgataggtttatggcatagattgtggtgatggtttcatgagtgtgtatttatctctaaactcatgaagttgtatatattaaatatgtacagcctatgtcaattatatctcaaagttttttaaagcttgtgtgagaatgcaaatatagagtcttggacagtggtttgatctaggtagaaaagtaaagaagagaatcaattaagatgtacatagttgcctttaactgtgattgtatctttatttcttaaaagagaagagggaaatgtgacacaaattggcaggtttttagatctgatagagctgggggatggttacataggagtcccctctattttatggggagattagtagggatctgaagccaagctgtctgagtccaatccagtccagctcaaccacttcaccagtgcgtgacaccttgggagaatgattttacctctccaagtgtcaactcctttcctataagatatggctaataacagtgctacaatgactaaatgagttagtgtttgaaagctcttagagactacaggaataaataagtgatggtgaaataaaaataaacaatgtattgcacagctcaagtaggtagaggacaggagagctgggatgggtgatgataaccttacttcaatctcatttttcatgacaaggaaactaaggttaggggagtagaattaactttgattacaaggtagaagcaatcagagatatcacactgggctcacaacaaaagaactgtataactggaaggctccttggtgatcctactgatagggacaggaggcagagaaattctagccagaaaagggtgagtctctggtgaagccccaccttcaagctgaaaagcctgaaacaacagcccaaagtgagaaattctatcgctgtttttccacttgaatgtttccttttcataaaccacccatggccccaccatgcctcatcctgtgcctataaagaccccagagtcagccagcagagaggaggagcagctggatgtcagagagcagcagcttgacttcagagggatggcttgatggagtaacttcagagaataatctggccagagatggctagacttcaagggaagattacctaccctctcatccgtccccttttcagctccccttcccagtgagacccactttcattggcaataaaatctcctgcatttaccattcttcaatttgtgtgacctcacttttcctggatgctgtacaagagcccaagagccatgagtgtagatacaaaaagctgtcacactggccctttgcccttgctggcagagggcagctgcctcacacaaaaaaacaaaagactcactgagctgttaacatttaagccatccacagatggcagtgctaaaagagcactgtaacacatcatctggggcttcaggggtcacaggcacccctacctggatgctgccgtggggcccacatggagttcactcctgctggtgccgatgtgtctagtcagttccaacactcatgcactccagttcctgcctcgttcgctcatgcactctctcccatgaggagttgagggcggtgggctatgtaaatgaggcattcctgttgtgagtcccatgaaggggtcagggaagtatcctgcttcactagcatttagtacagaagttgacaaaacttttccatagaaaaacaggccttgggtaggatttggctcatggactctcaggctgtagttggccaacaccttgtctaggggttctcaaatattctatgcatcagaatcacctggagagctagttaaacacagattggtgggccccacccccagattttctgattcggtaggggtggggcctgagaatttgcatttcccacgagttcccagaggatgttgatgctgctgggccaggggccacatgtgggggtgtccaccgttataatgtaactttctcattttatacttgaatagaatgaggccaaactggatcaatgaatagaattgatccaattttgttaagtgagatcagacagcaagtaaaagaatttaggcttcattcgaaatcttgtttattttaaaataacatataaagttacaactgtatcctgggtgctgtgctaggctctgggtatataaagataaatgtgacatggtccttgccttccagaagcttgcagtatagtagaagaaatgagataatagatgatacagtatgtaagactcctgggagcataggaaacattgggaccccagagaattacctggtttcttgaaggaggggccacctggagtatcttgaagaataaatagtcatccaacaggaaaaataggcaggtgaggggaggaaattccaggtaaagggaacagattgtgtaaggcataagagaagcaacatggcatcatgcttcacagtaggaattctggctctgctacttactagcctgggtcagttatttaacctgaaaacctcagtgtcttcttccaaacatagggataataaaagaactgaccacctagggttgatgtgtgaattacataagataatgaatgtatagtgttttggcctagtgcctgaaacacaattagtccttaataaatatgggcaattgttatttgtgttattattatagccagtgatgtatcagagcatgatacattcacagtcattaatgaactaaagtatgaggtgcaggtggagctactgaggcgggcaaggccagaaaatgaaggactctagtccctgcctgactcagggagggcagtgagcagagagtggcagaagagtggcattctaaggtctccattataattgaaggaggagagaatgattaagacaagtgatgtggtaaccaagaattgggaaaagattttgaagaaaagatgatgaggtcaattttggaaatcagtgggatatcgaaatggaaatgtctggaactcaaaagaaagatcttggctacccaaattcgaaatccctgggttggcagttgaatagatggaagtgaaatatcaccctgcaatattatgtagggagaagagagttcacaccaatgcttaaaaagtcagcattgagaagtagaaaagaagtagaaaagaagaatcatgagacagcatccaagtagctaagagagaataattttaaggaggagttgcagtcaacaatatagaatactccagagatcaagcaagataaagatcagtgagtaacacctggatttagaaccaggagaggcaacttagacctctgctttatactaggtggaatgcattgtgtacatttcataaagaaatatatatttgcatataaggtaaaaggggataagcagaaattaagtcaaagagcaatttttctccccataatgaacaaaataccctcctcctaaaaacctcaagaataaagatttgaaagctttactctcaccctctccccaaggacattccaagccctctgtgatccccagatgacactagaccagcctcaactcctctgacatttttatgaagattgtcttaactatgcagagtctgtattttcccaatacacaccgtgacttttctagcctctgtgcctttggtcatcctgctccctcagtgaagaattcccttaacttttcctaaaataaggaaataattctctcataccttaaagcttgattcttgttccataccagaccctcattatcttgcccacctactactatcctctggcccaaaactctttatagcattttttttttcacaacctacactccttttatttacctcctcaattcctcaaggtgaaaaactactccctctctgttggtgtgtattctatccaattgtttcgttgtatccaagtgcctggtatacagaaggcagtcaataaacagtattgaaaggatggaggaaacaggtatcatgcttaaaatgcatttctaaataattcaggacaagcaaaagaaaattaattaagaagttatgcacataaactgaacaactgagtgggatacagagaactgaagtttacagagaggatgtgggagaggggacggcttacgaagaagaggaaagtaaccaggtatctactaggcacacttgtcaaaagtaattttatcgtcacataaactttaaaatactgttatcgttcccatttcaagaatgagtgcacagaagcttggagaggctaccaatttttgcccaaatagagcagcttatgtcagtacaaaattgaatatgattcttacaatacttcaggattctgataccatgttgctttttggaattagaatacagaagactaaactgaattaaacactaaagcaagatgtaaatagagacttggcatccattaactgatctagtaaatggcatctgtactgctgaggcaataacagatacgtgtataaaaaatggatttataaaggagagaaatcagatctgtctcatctacttgcctcatacaattgtgatgagaagcaagtaagacaatgtattttgcaggcattttgcaaaactggaacaactctctgtatctaagagacaataagttataggactcctgacttcctccctgctctacactctttaaacatttctcttgccaattttttgcttatcctttcctttttgccttaatcatcaaaacatgattgcaattaagacttggtgtttctctgggtcctgtttcgaattattttaataacatggtatatttcaagaagtatttcaaatagtgtcatagaaattttgactaggggtcagaaggcctgttatttctcttggcctcactttctttacctgtaaagtgagagaacggaattaaatgatttctaaaatttttcccaactcatgcattttataattatttactcttctgaaattcctgtgataagggaagtgtagattaattctcccccatcttgacaatttggttcttaggaatctgagaatatctttattttcttgttcttgatatgattccaagaaagcaaatacgtattagacaaatttctctctgagtattattattgtagcactgaaatccaggatgagtaactttttcctctaaatattagattaagttcctattctcactgttgacagggattaaaaaaatacttccattccacacagcaccttttgtcagctagaagctgatagaaaatttcaggggagaagtgatcatcttaaacagcaggccctggctttaattcagggaatgaaagttacattgattttttttaaagtgatctgaaaccagcaggaatctctatccaaagcccagacagatggctgaaccaatgggctccctgtgatcatctctgctacccatatatcatttgggtagaaaataaatgggttttaaattacctttagttccagatagacctagaaattaaatctctacacatttgaaaaaagctaataccaccttaagctgcattaatagaaatcaatttctttgtcatgggaagtaattgactcattcaccctatatttaagttagaatattcatttcttttaatcatatgctaagtgtaaaagtaacacattagagtttgtccaaagaataatgggtagtacattaagagggtctgaaagtcatgttctctataagacaacagaggattgtaattcagataaaagacgatttaagagagacctcataatggtcgtcaattattaatatataatacagtacattctatgttattcaggaggacatagcagataaacaggaggaagagatatttgattaaatggtacagagaagattccaaaggatcaagcaatcctgagttagaacaggtcttctcagaaggtgacactgactagacacacaatgtgtgaaggagtgggcaaatggctatcagttggagatgatatagctgggaagtaacaaatattctttataaaattaagatcccctttttcctttcttttttttcttttttttttttttggagtcattctcaagtcactttcaaaatcaataacagaaaaaccaccatctcccctggaggaaagacatgggctctcatcttcatctgtaaacatggaaccctgatatcaggttccataaatatctgctctatttatgagtgctcatgtttgttttccactagtggtatcatttttattacaggtattaggaccctcatatccttttctatgatagcaatttgctctctgtttttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaaaaaatgtcttgtttagagttcaccctatctgcaaaagtcttaactttggagtcagtcacttaacattcttggttttagtatatatttcaggaaaagatgtaataaatcactccaagatacaaatgcatctgggaagcagaatcattccactggaaagcaagacaaagggggcagtgctctgcaggtactaatcagatagaaagaagcagctgagagcgatttcttgcatctgtttatcaagtacataaatactttaagcacctactgttagccaggcaccgtgcaggcagtatagcgggtggaaagatacaaattacttgccctctaggacttgacagtctgtacacacaaattcctataatgtgatgtctatcgtaaagagtacaaagaaagtttaagaattcagaattgaatttgatcattttcagctgaaacatcaaggagccatgaaagggggtaatctaaagctggcttgtgtggaatgagtcagatttcaacaggcaggtataggagccctcagggtggggtagagtaggaaaataatctgaatatgctgagaggcatgacaaagctgctgagctgagaatgctgaggacatacccagggaagagttaattagtccaggttgacagcagtagctacatgctggggaattgtgactgatgagcttagaagttgaggccaaattgcagatggctttggctaccaggagagatgtgtagacattaccctacaagaaatgggaggtcattgaaggttttcgatcaagggtataataggatgctgttgtgctttgattagtcttgttgcaatgactaaaaaatgattgaagaaaataaaaacaaggtaggggtttatcacaatattctgaaagcctgaaaccacaatggtagcagaaggcataaaataaaatgacatatataagaattattttgtagttaaaagctatgagtttgagcaatattgactttaagtggtgggcgttaggaagaatcaagatccagaaggctaaacaggagcagaagtactttcattgccatctcacatattcacttatgattgcgagagtctcactgaatccaggtgtgaccacaggatgctcagaatagtaccatggcagagtactcagaatgtgaattctgcagctggactgcctgggtttgagtcctgattctgctacttactagctatgcggccttgagtaagttactaaaccagcacatgcctcctctcataaaatatggccaacaatcataataattcctttatgtgaaagttaggagaaataaacaagttaacatttgcaaagtgcttggagtcatgcctggcacaaagtaagtgttttacaagtgtttgttaaaacaaacaaaacctcactatgttcacatagtcctatattaatgtgagttgccattgtgggtgaaacttttggcatctctgcccatctcctaaagcgttgtcttttctttgttcttaatcttttgtttgaaagctatattttctctttagccaatttcattcactcagtggctataaatatcatttgtatgttggcaggagacaaatgtgtatgtcccctcagacttctcctgccaacaagatgccttcttttgaaagtttcacaagtgcatcaaaattagcatgactaaaacagaatacatttatgtgctgcatatagatgtttcagtcagtggtggactgtatatacaaccataatcctataagattatactggaataccatatgttttactggcccttttctatgtttagatatatttggatacacaaatactcgccattatgccacagttgcctacagtattcaggacagcgatatattgtgtaggtttgtagcttagcagcaataggctataccacatagcctaggtgtacagtaggcaatgtcacataggtttgtgtaagtgcactctatggtgtgttcacatgacaatgaaatagtctagcacatttctcagaacatatccccactgataagtgacacatgactatttgaatctccccaccccaaacctgaatcacctatagtttaccaattcagacaatggcaccatcattcatggaggtgttgtaaatccaaacttaagattcatccttcgttgcttttttttcccccattcaatacatcagtatgttctgtagacattgtctccaaaacatttccagagtcagtcaatttatcgctctctttactcctgactctccaagtctagtcactgttatttctcaaaagcacttctgtaatcgacatctaagcagtttctctaattccatgcttgcccttttctagttgattctccccacaacggctaaacagattggtaaacaatgtatatcatgcatgccactactctggttaacactctataatcactcactactgaataaagaattaaacctcaatattctcaaatggcctacaaggcctcttcttcccagcttctcattctcttttcatgtccttcaatcccttccttggctttctctatcatcttccaacatgccaagctctttctcacttcaaggacttccaaggtttgtgctccaccttgttgcaactttctaaacttgctggtccactgaacaaattctacttaaccttcagggctcccttcaaatgacatcttcccagcaaggccccccaactcttatttccttcatagaatgtgcatactttgaaaatacgtatttattgtagacttgtttggttgatatttgcctcatctcctaaattataagctgagaggacaagaccatatttgttttgttcactgctatacacccagaccctgtttagtgcctgggttgaaatgtatgttttgacaagaaagaaaagaaaaaaaagggaaggaaggaaggaaggaaggaacgaaggaaggaaggaagggaaggaaaggaaggagggagggaggggaaaaatgaagaatggaggaaatgaagagtgggaagggaggaaggaaggaagaagaaaagaaaagaaaagaaaggaagaaatgagggagggatgaagagagagaagaaaagaaacaaaggaacaaaggcacgtaaaccctggaagacaacctaggcaataccattcaggacagacatgggcaaagatttcatgatgaagacaggaaaagcaattgtagcaaaaaccaaaattgacaaatgggatctaattaaactaaagaacttctgcacagcaaaagaaactatcaacagagaaaccagacaacctacagaatgggagaaaaattttgcaaactacacatcctacaaaggtctaatatccagcatttatagataacttaaattcacaagaaaaaaaaaaaactccatgaagaagcgggcaaaggacatgaacattttcgacagaagacatatatgcagccaacaagtctacaaaaaatagctcaacatcattgatcactaaagaaatgcaaatcaaaaccacaatgataccatctcacaccaatcagaatggctgttattaaaaagtcaaaatataacatatgctgacaaggttgtggagtgcctatacatggttgatgggagtgtaaattagttctaccattgtggaagacagtgtggcaattccacaaagatctaaagagagaaataccattcaactcagcagccccattactgagtatatacccaaaaggacataaatcattctattataaagacacatgcatacatatgttcactgtagaactagtcacaatagcaaagacacggaatcaacctaaatgcccatcaatgatagactggatgaagaaaatgtggtacatatacaccatggaatactaggcggccataaaaaagaacaagatcacgtcctttgcaaggacataaatggagctagtagccattatccttagcaaactaacacaggatcagaaaatcacatacttcatattctcacttataagtgggagctaaatgatgaaaacacagggacacatagagggtaacaatacatactggggcctttcagagggtggagggtgggggaagggaggagggatcaggaaaaataagtaatgggtactaggcttaatacccgggtgattaaataatctgaacaacaaccccccatgacataagtttacctaggtaacaaacaaacctgcacttgtacccctgaacttaaaaggcttttttttttaaaaaaaaaaaaaaaaagacaggcattcaccaaccctgatgagtagccattgacttttgcctctcagacctggcaaggcattgaaacaatggagttaagaaggataaaccagtttggtatgaaaagaggactcacttagttttggcttattatcattcagggcacacatatttactgtctcctccatgcatgcttcccacatgttattacagaaaagatattagaaaagaaatgaatacataacaacttcaataaatatgaacaagtggtacttgtaagaccaggaattttgaggagttttcagaagatatcaagtgaataggatcagatttaataaaataataaataaataactaggactgagaataagctccttgtagtataatagcttttcttcctaaattctcactggctccttagataaaggttaaacctgctgacaaaagtactcggagcagaagcagcttacatagggcaataactagagtacaacctatgaaagccttggctgcttttccttctcctcctttgcatattaatgctaagtttggatatggcatttgctcccatattgaaaccgtgtaaagggccttccagtaaagcaatacagtgtgtatgagtatgtgtgtgtgtgagagagagagtgtgtgtgagtgtgagtgatgtgtgtgtgtgtggtggcttcctactatgtgcctggggccagagagaagcagaccaaaccaaggtaacttcagaaccacacagctgacacagaaatgaaaaaataaggacaattctttagaggactaaaatgcaaccatacatatcacttcctaatgttttccttactttagaaatagatttcaccaacttgtctctttatcctctgctcctatatcttgaaggaagatggtgaaatcagcattgtctccatttctaaccctctcattaaaagtagggggctatcataggcacaggtgtaactgcagaggaaatcataccagcttccaataccaactgagctctttgtttaaaacaggaacaaatagataaacataaccagacatctgagggaaatcaatagcatgagagagaagaaccaagattaacaaagaaaggtaacataaaaaacaaaagaaaacttttaaaaagttcaatcagtatacttgcaagaatttagcaaactaatatgtctataaaataagaaaatactcaaacggataaatagaaaaaatgaaaagtttttggaaattaagatataattgtcaaaatttaagaaggtaacagaagtcctgtacaaaagaatggacattgctgaaagccaaagaagaaatatggaagataagaaaggaaatctaaaaattaacataaaaaggcagagatagaaattgagtgcacagaaaggatacatgttgcgggaagtcagggaccccgaatggagggaccagctgaagccatggcagaagaacataaattgtgaagatttcatggacatttattagttccccaaattaatacttttataatttctcatgcccatctttactgcaatctctgaacataaattgtgaagatttcatggacacttatcacttccccaatcaatacccttgtgatttcctatgcctgtctttaatctcttaatcccgtcagcttcataaactgaggaggatgtatgtcacctcaggaccctgtgatgattgcattaactgcacaaattgtttgtagagcatgtgtgtttgaacaatatgaaatctgggcacctcgaaaaaagaacaggataacagcaatgttcagggaacaagggagataaccttaaactctggctgcctgtgagccaggcggaacagagtcatatttctcttctttcaaaagcaaataggagaaatatcgctgaattctttttctcagcaaggaacatccctgagaaagagaatgtgtccctaaggggaggcctctgaaatggccactttggggacagctgtcttttacggtcgtacataagggatgaaataagccccagtctcctgtagcactcccaggcttattaggatgaggaaattcccgcctaataaattttggtaagactggttgtctgctttcaaactctgtctcctgataagatgttatcaatgacaatgcgtgcccgaaacttcattagcaattttaatttcgccctggtcctgtggtcctgtgatctcaccctgcctccatttaccttgtgatattttgttaccttgtaaaacatgtgatctctgtgacccataccctaattgtacactccctccccttttgaaaatcactaacaaaaacttgctggttttgcggcttggggggcatcacggaacctgccgacatgtgatgtctcccccagacacccagctttaaaatttctctcttttgtactctttcccttatttctcagactggccaacacttagggaaaatagaaaagaacttacgtgaaatatcgggggtgaatttcccccgatagatatggaaattataaatggaaagaaaaaaaggcattaaagacccatgtgttgcaaaaactatccagaatgagagagtaggggtaacagatgggagaagataatcaaagaaataatagaagaaaatttttctaggaagtgacttgaatattcatttagtcgataagatttactgagctcttactttttgccaggcattgttcttagcatttacagatcaggaaacaaaacaggaaaagaaatctctgcctcccacaaataattaacaaacatatacacttagatatatcccagtgacatttttgaacttcaggaataaagatgatatcctaaaaaagccagtaaggcctggtctggtagggaacatttatctacaaaagcattagacttatctgagactctttgcaagctggcaatagagtaacacctaggactatcttaaggaaagaaggtaattttgacactagaattttattaccagatgaactgtcagtaaagtgtgagggtgaagacaaaccttttattggacacctgaggactcagaaaactcatcactcatatatccttctggtgaaaaaaaaaaaaaaaacaaagcaaaacttaaatatggagtttccaaaactataaagtgaatttaaatatataccacaatatgtgagaaagaatagaaataatctaggcagtaaaacaaatttagtgtgatatctgaaaacaaggttagaaagccatcagttgatattagaacagcatgttggaggctccaagaatgtattcaagaaaaagtagttgtcataacaccaaattcctgattaaaaatcaagactgtaaatgtattgtgaaactgatatattattgtgtgatatattataaaaagtcctataataatatattactgataccgtttcagacagatgagatgaagggttattttctcccaattagccataaaaaggtaatattttcctagtaaaaataaatgcaagaatggcagtgtctgaatataaaactcttttaaatgaggcataattctgggcaactgatatagtgttagaaagatccttcaggggaaacccatcatatctctaagaataaggcagatagcctcaaataaagcataaaagtatttataattgatattagctacaccctgtgaatttcaggtgatcacatggggaggtaaagctgaccaaattcttggaatatgaggttgtaactgggaagtgactggaactagggtgggagattttgtagtagttcacataaagcaggtgaccactgatggaagctgtgagaagaggagatggcagatgaagaggctctggaagtctaccttttaggaggtgacatgaggaagagcaggcacagcgggctgcaaaggaaccctcaaatctataaatatgcactcttccagaaaggaagaggaggtgtccaaaatgagactcactggtgattggtgattggaaaggcgacaagggcatttggcaggaagtgatgacccaattctgttcagtgagggaagaaggcagcttgcagggcaatttggaattggaatgcaaaaatcataagtcaccatggcgtctattcataagaagtcatgaagcgggttggtggggagaaagaagccccctaacctcagccatgatcatcaaaacgggtccttcaactgaggctgggctgggaaagaggagctggcttgctagtgttgtgaaattttcaaagtaagagcatcccatgctggatacttgctgcataaaagcctttgctatatagtttatcttttttaagactgttatagaaactacattttataagtgtccacaggcatatccctgtcatgcttttgcagttataagaagtagaattcctggttgggagttatagtcttcctgtctttgattttcttctgcttgacaaaaaggaataacctgaggttaaagcatcctgctgtgtattctgtaaacaatcccattatcatacaaccacccagtgagcactacttacccttacaaagtatcaacagataactaaactgctcttcagtaaagctatatctgatttcaagtacaaataaaagctctaaatagtcacacagaatgatatagttgatgtaattcaagctctgttctttgtgtttacaatcatagtgctattgtttattttatatgaactgctgaaattcaggaatatgtggtacaacagcgattagagacacgacttggcctacagtagctccaccaatctggaaccctttgaaatgttctcttggaacaaaactcatgtagctgaatgcctctgtgttggaggctaactgaataattagagtttcccccatcaaattctatgtaaaatacagtgcatagtagagaatcagtaacaaaaacatgcaattgacccttgaacaacatggggtgtgagctacgtaggtcgacttatacacagattattttcaataagttacactgagggtgcctgcccatcctgcttccccatctatctacctcttctgcctctgccaccactgaaacagcataaccaacccttcctcttttccctcctcctcagcctactcaacatgaagacaaggatgaagatctttattatgatccacttccacataatgaacagtaaatctattttcttttccttatgactttcttaataacattttattttctctagctttgtttattgtaagaatacagtatttaataaatatataaaatacgtgttgatgaactatttgttatcagtaaggcttccggtcaaccataggctcttagtagttgagttttgggggagtcaaagttatacatggatttttggcggcatgggggtcagcatccctaatcaccacattgctcaagggtaaattgtattgttaaaactcaacagtaactacagcaattgtttagagcttagacccacaaaaggtttttcgaagtggagtattttatcactggcatttttacaatttccagcacctggggataataaaaagcaggtcatttggtgggtttcattattattattaaattctctccagacaatgcacgctgttactgcctgcacccagcatggaacactccctatgttccttcctttgtgcacttctgactgtgtagatcctgaagttccaaagtgtttctcaagaggttgattagctagaaccacttgtgttgattggccagaaatttcctggtgtgactaggaaagccatgaacctctgagaaggattggtacaaaagcctatccaacaggagtacttcatattggatggctgcaacgtgacccaaaccctctcagtgctgaaatatatatgcaggtttatatacacttacatgaggtagtgtctttaagtacaatacgctgtagttggcacatactgaaaagccttacacgtgcctccctggatcagatggaactcagaaggatcaggaactcagtaatggtacaattgatcaggttgcttttatacaactttaaatagcctaaagcaaaattataataataaaaatcgtaatatctttgtatactttcatagtctatgatgcaggactaactctaatacaaaattttatttttacaaaaatgtttgagacacatttctcattgtcttattgtctgtattttacaaatgagtaaactgaggctctgagacattaggtgattttcaaacattattgtccatcaaatggttggaacacaatggagtgggatccaaagcatgaccttctaagtccagtgggctttctgccgtgcagctctgaagtgtggtaataatagggactctcataaatgaaatgataaataggactgcttactggttacatgaagttttcaatctgttattaagtagcagttcagatttcactatgtttaatccaccagcaatgatcttttccatcttgcatacctggcagatgcctattcatcttttaagccctatgtcaagagaagccttcatctgcaaagccttttctgaccccaaaggtagggttagttgttttcttttttctgcagccaatccacatgtgtggatcccaccactcatgtctcacatgccttattaggctaaactgtaactcttaatttgcatgtctgtctctaaactcaactgcgagctcttaagatcaggagctgtcatttattctgatttgtatacctagtgtctagcagagtgtctggcacatcaggctctgagtaaattttacacactatgcatccccatttttggggaaaagaaataacaaagtatttctaattgagggtgagtcagtgtaacatcaccctctcatactgagagaatatatccattaaattctgcttgcttcctcttagagatgaaaaatcagaaatctagagagagagacttgcatcactgcctccacttacaaacactgatattgagaacataataaaattatcctgtggatgaaatcaatattctattccttaatgctgctaactataacttccaaaccaatcttagcaagctcacaaaaaaatatcagagctggaatggttctttggaaaccatgcagctcaataccctgattctataggtgaggaaaacaagctcctgatatgctaagtgacttgcctaagatctcatgtttggtcagtggaagacacaagccactgagcattttccagaacccgttgctgcatctattatccaaaggaggaagacaattgataacaaaaagtccgggggcacaaaatactggtgtgctcacccacacacacactccctgcccaagaaaattcaatggctgaattagaagatctatcaaatgtaaatgacaagttaacaggtgcagcccaccaacatggcacatgtatacatatgtatcaaaactgcacattgtgcacatgtaccctagaacttaaagtataataaaaaaaaaagtgctaaagaaaaaaaaaaaagaaaactcaatggctgaaatatgaccttacacagttaatgactgactacctccaatggagagagttattcaatatgccacagggctcattaaaatgcaagttttattcttaagataacttgaaacaaaattctactctcaaacacaaaggtttacatacaattttgtagcaaaacaattgatgtcataaagtaagacatcaggaggggctttggagtacagtccaattcgagaaatactacctgttaatgcaagtgatctggttctaggtccaactccatcattcatttgttctacaactaaagatcaatctctagccttgttgaatcttccacatttactgattggtgatagaaatacgtgtctttttataagttgtcacaaatgagacaaacacatgttgatatcacgtaccctctgataggatgtaatgcaaatggaactctatctccagggaacctttccccaaaactcacaatcccagattaaccaagaaaagcatcaaacacacagaaattcaggaattttatacaaagtagctcaccagtatttctcaaaactgtcagtcatgaaaaatcaaaagattcagaaactttcacagcccagaggagacgaaagagacatgaaggctaaatgtaatatggtatcctaaattggattatgcaacagaaacaggaccttagtggaaaaactcggatattaaaaaaaaatctggagtttagtttaccagtaatgtatccaggttggtttcttagttttgacaaatgtattgctaatgtaaggcattaaattagggaccttggataaagagtatatggaaactccctgtataacttttctgtaaatctaaagtcatcccaaaataaaaaaattattttgaaagatgacacctggaaaggctttctaaaatgtaataaatgatatccaaatgctagatcatgtctagagagaagatagatttgtgttgagttttcagtggattaatctggcatatagccttttatttttgcctgtagttcatttttttctagaagataagcagaacagtactattgtctatccaagaagtatcacctgttaatcaaatttatacatatttgtagtggaaagagcattggattagaaatgtgcttatttataaacctgcttctacgttgacctgcattggaaatttagatagtaactttatctaatttgctttgttttctcatctggaaaaaggggagtatgagtgcaaattttgtaagggatgaatgaagtaacatgagtaaaccagtactgacaactataaaatcatatgttcatgtgatgggttaattgtgcttccattagctttggagataatgtaagtatgaaaaaaagaataatggtcttcccaaaatgtccatattctaatccaccaaacctgtgaatgtgttaccttatatggcaaaatatattttgcagatatgattatgtcaaggatcttacgatggggagatcatcctagattatccagatgggccaaatgcaatcacaaacattctgaaaagtgggaggcagaagggtcagagttagagaaagatatgtgataacagaagcacaggctggagccatgcaaggaagggaccctgcactgagtaatgcaggtggcttctagaaggtggagaaggcaagggattgatttctcctcagagcctccataatgcaggctgccctagtgacaccttgattttagtgtgtccaacttttaaaatggtaagataataaatctgttgtttctagctactaactttagggtaatttgttataagactgatatggttagcctttgtatccccacccaaatctcatcttaaattgtaattaccaggtgttgagagacctagtgggaggtgattggatcatgggggcagtttccccacatgttgttctcatgatagtgagttctcatgaaatctcatggttttgtaagtgttcactggttcctctcttgctggcttcttctctctccttcctccatgtgaagaaggtgtttgcttcccattcaccttccgccatgattgtgagtttcttgaggcctccccaggcatgtggaactgtgagtcaattaaacctcctctgtttataaattacccagtcttgggtagtatccttatagcagtgtgaaaaaggactagcacatggagctataggaaactaatacaattactttaactatcacttaattgggatgtattgaaggataaacttactggcttatcaaagggagactgaatgtgggtctcttggaaggggtggtcacatactgaatttctgagggagaaaacctcataaattcactatatgccgcaaagcaaagctttcaagaagtggtgtggccacttttttttttttttttttttgagatggagtcatgctttgttgctcaggctggagtgcagtggcacaatcttggctcacagcaaccttcgcctcccaggttcaagtgattcttatgccccagcctcccaagtagctgggattacaggcacccaccaccatccctggctaaggtgtggctacttttaacagcttacagtaagatatggcagcaaaggaattacctaaaggtggaatttgtaattaaaaggaaagcagaatataaaaacatgaaaaatttacagtctagcaatgtgacaggaaaggaaagaatgttttcaggagaaaaatccagtggtgctgaggggtaaccacttgttaaagagattaaaatggataaaagggagtcaggtgcaaagagtcaaaaaaattggaaaaaggtttttcagaaatctttgtagccccctcccatcataggcccacaggcctgggaaaacaaaatggtttcagggaacaggcccgagttaccccgaagccactttgatatgctttctcaacattcaagctgctccagctccaggtgaggcacaaataaccccacatactatttcagctggtgctccagagggtgcaagccataaatctcagcagcatccacttggtgctaagtctgtaggctcctagaatgcaagagcagtggaagctgccaagcctgtagatttcagaggatgtattggaaagcctgggtgcccaggcagaagccttctgcagggaaggagctcctacagggagcctctactagggcagtgcccaggggagctgtgggaacaggagcaccacacttcagacaccagaattatatagccactggcaatgagccacactagcatggaaatgctgcaggtattagattccaaactgtaaaagcagcaatgtgggctgcacccagaaaaactgtgggggcagggctttccaaggacttgggagcccacttctcatatcagtatgcccaggatgcaggacatgggtcaaagaagattattttggagctttaagatttaatgtctgccctgctgggttttagacttccatgaagactgcttacccctttcttttggccaatttttgtctttgtgaacgagaatgtttacctaatgcctatacaaacattgcatattataagtagatgaattgcttttgatttcacaggctcataggtggaaggaacttgccttgagtctcagatgagattttggatttgggacttttgagtagatgctagaacaagttaagactttcgggaccattgggatagaatgattgtattttgcaatgtgagaaggatgtgaggcatggagagtcaagcgtggaatgctacagtttgaatatctgacccttcaaacctcatgttgaaatttgattcgcaatgttgcaggtggggtctaatgagaggtgtttgggtcatagaggcagatcccttatgaatggcttggtaccacctttatagtaatgagcaagttattgctctattggttcctgtaagagcttgttaaaaagaacctggcaatttctctgtatctcttgcttcctctctcaccatgtgatctttgtacatgctgcctccccttccacttgcactatgagtagaaacagcctgaggccctcaccagatgcagatgctggtgccatgcttcttgtacaccagcctgtagaatcatgagccaaatgaatctctttatctcaaaattctttatgaattatccagcctcaggtattcatttacggaaacacaaatggaataagacagcccccaacattcctacctcatagtgtacacaccctctagtatgagtgagatttctgagtataatggaatttcacttccttgagtagactgccatttctggcaaagatgaacagattttgcagatgtgaataacgttcttaatccgttgactttcagttaataaaaaggcatgttatactgaataggcttgacctttaaaagagagtctaggccttctcaggatagggagatttaaagtaagtaaggcactttcctgccaaccttgaagatgcaaactgtgttgtgaactgcttattcagcagtggcaggccataggagacaagggtctcagccctacaactgcatggaattgaattctgccaaggacccacatgagcttgacttcagatgagaatgcagccagaatgacacctttttcagccttatgggactcagtagaggatccatttaagccatgtccagacttctgacccaaggaaactgtgaaataacaaatgtgtgtcattttaaactactaaataaatggtaattcttaagtagcaaccaaaaaatcaaggcaggtaccacttactccatgaattaaggaatgaagagcatgcacagccccaggctggccatcctggatcagcaagtaaccctcaccaaccagccagatttctttcctgggagtactgtgaagaaagaagagcttacactccttacctgttaatcatgagactttttttttttttaaagtggacattttgataaacaattagacatcagtggtaacttgtaggtggttgggtataattaccttccttgtccaataatctttagattttaaaactacccaaaaagaaaaggatggaaaatagcaagctgggagggttattgacctgggtaaaccatttgtacccaattttaaagaatgcaacagatgatgctgtcctgagccaaagtagcctgctaggtccaatgctgatcagaaatggcagcaatgagttcctctattaatcattcagaggaattctgtattatgattttaagctgctgaataagtggtgatctaattcctcagaaattcctgcttcccagatctcagaggaagagtaaagtgcttaaaactatctattgtcctttatttccaggatctccatccaaatactttatgtggcccacaaggccctctatgagctggcccctgaccaccccaatctccaaccattttgcacttgtcactttgcactctggccacagtgacctttgttccatttctcatacatgtcatgcccacgcttgaggctcatgcttctgccttaaacagctggtctaagatgactctgcactagcaacgtccttccttagcttagcttctcctagattacacaaggaggctctccttgatctccagactatttctactaggctttttaaaaccttgagtactttccatttatagcatgtactacagattgtactgatgtgtttgttactattattattttataactcaatttaagggttgaggaacagcctttcactctgtctcccgagtcaagcctttgtctttttctttaaggaatattgctgtctattctgacccaagtttgtttggcaaacattgagcccctggtgcatggaaggcctgaggtatatcctcgaggaataggtggtgggaagagataaggtccctaactctagaagctgaaccatccctaggcccctcactgctcctatcttagctcatatggccctcttctctgactttgaattctgtaagagtttcaatctctcctttgattctttagggtaaaatccaaacttctagttcctttcaggtaaaatccaaactcccagttggtatggccctccataatcaggcccctgctgctctccaaggccttaattcccagagctcttcttgcactagtgaacattctcttccaagcttccaggcttttgcccattgatatggtttggctgtgcccccagccaaatctcatcttgaattgtagttcacataatccccatatgttgtaggagggacctggtgggacataattgaatcatgtggacagttactcccatgcagttctcttgacagtgagtgagttttcatcgcatccagttgttccttcactcagctcttctccttcctgctgccctgtgaaggtgacttgcttcctcttccaacacgattgtaagtttcatgaggcctccccagccatgctgaactatgagtcaattaaacttgatatctttataaattaaccagtctcaggcagttctttatagcagtatgaaaacggactaatagagtaaattggtatcacagagaatggggtgctgctctaaagatacccaaaatgtgaaagtgactttggaactgggtaacaggcagaggttggaatggtttggagggcttagaagaagacagaaagatgtgggaacttcctagagacttgttgaatggctttgatcaaaatactgatagtgatatggacaatgaaatacagcaggctaaggtggtctcagatggtgatacggtttggctgggtccccacccaaatctcaccttgaattgtaataatctccacatgtcaacggcagggccaggtggagataattgaatcatgggtgcagtttccaccatactgttcttgtagtgaatgagtctcatgagatctgatggttttatagacgggagttcctctgcacaagctcttttgcctgctgccatgtaagacatgactttgcttctccttcaccttcagccatgattatgagaccttctcagtcatgtggaactgtgagtcaattaaacctctttcctttataaattacccagtcttgggtatgtccttattagcagcatgagaacagattaacacagatgaagataaaaaaacttgttggaaacgggtataaaggtgactcttgctatgctttagcaaggagactggtggcattttgctccaccccagagatctgtggagctttgaacttaagagaaatgatgtagggtatctggcagaagaaatttctaagcagaaaaccattcaagatgtgacttgggtgctcttaaaagtattcaattttatacattcataaagagatggtttgatattggaacttatgtttaaaagggaagcagagcataaaagtttggaaagtttgcagcctgatgatgtgatagaaaagaaaaacccattttctgaggagaaattcaagctggctgcagagatttgcataaggagccaaattttaatagccaagacaatggggaaaatgtctccagggcatgtcaaaggtctttacagcagccctcccatcacatgcccagaggcctggaagagaaagtagtttcctgggctgggcccaaggcctagctgctttgtgcagtctctgggcttggtgccctgcattccagctgtggccaaaaagggccaacatatagctcatgctgttgcttcaaagggtgcaagccccaggccttggtggcttacatgtggtgttgggcctgtgggtgcacagaagccaagaactgaagtttaggaacctctgcccagattttggatgacgtagggaaacacctgaatgtccaggcagaagtttgctgcagtggggagccctcatggagaaactctgctagggcagtgtggaagggaaatgcggggtgcgaactcctacagagtccccactggggcactgcctagtggagctgtgagaaaaggaccaagatcctcctgaccccagaatggtagatccaccaatagcttgcaacatgcacctggcaaagctgtggacactcaatgccagcctgtgaaagcagctgggaggtggactgtaccttgcaaagccacaggggcagagctacccacctcttgcatcagcatgacctggatgtgatacacagagtcaaaggagatcattatggacctttaagatttcactgccttgctggattttggacttgcatggggcttgtagcccatttgttttggccagtttctcccatttggaatggctctatttacccaatgcctgtacctgcattgtatccaggaagtaactaagttgcttttgattttacaggctcataggcagaaggggctggccttgtcttagatgagactttggactgtggacttttgagttaatgctgaaatgagttaagactttgcaggacagttgggtaggcaggattggttttgaaatgtcagagacatgaggattgggagggacccaaagtggtacggtaggtttaggctttgtgtccccacctaaatctcattttgaattataatccccataatatccacatttcaaaggagagaccaggtgaagtaattggatcttggggtggtttctcccatgctgttctcatgatagtaagttcttacaaggtctgatggttttgtaaggggctcttcccccttcactcagcacttttccttcctgcagccttgtaaagaaggtatcttgctttccctttgccttctgccataattgtaagtttcctgaggcctcccggccatacttaactgtgagtcaattaaacctctttcctttataagttacccggtctcaggcagttctttaaagcagtatgaaaatggactaatacaatccctctttgcctgtgctgtcaagtattcctcacattaccacccttctccactttgagtactcctgaaccttgtcaagacccagttctaacttcctttcttcctttagccttgtagtgagatgcctggccctggaagactgctttaggctgcaagtgacagaaagtctgactcaaagtggctcaagcagtaagaagtttgttacgtcacttaacacaataagtggtgaggcagttccatggtgaattcaacccttaagtgagccatagaagatatgggtttttctcaactctccattttgccatcttagtgtgtcttttgtacccaagtttattcagaaggcttctccttacatggcatgaatagaactgtttatcacatatgcatgactatattaatgtattactctgggttctcctgagaaagagaatcaacagaatggggtgacagtgagagatttatttaagaaattggctcacatgatggctggcaaggatgatgtctacagcgtaagccgataggcaggaggcctagggaaatgttgatattgctgctcctggcctaaggcttctggaggcagaactccctttttctttggggacattggtctttttctcttaaggccttcaactcattggataaggcccacacatattatacagataatctgctttactcaaagtttactgatgcaaatgttaatctggtcttaaaaagtacctgcccaacaacatccaggcatgtttggtctaatatctgggtacgtacctagccaaatggacacatcaaattagccatcacaatgtctaaaccaattactgagaagaaagagaccagaatcaccattgttggtataaatctcagccaagagtaaccctctggggctggtaaggggctccttccctgagtatatgatggtatggagggcgaatgtgcaagcatagtcagggctctgcctgcaagacagactctagttgtgggtaaggtcagaggaaggcataggtttgagcaggtaaacaacatctgttaaacacttaggcaggcagaatcccaatactgtgttgcctcctttacatgtataaaccctgttggagcccttgttaccctgagtcatggatttatggcttatcttcctctttagactgtaggctcacctttgagtaagaatcatgtgtgagttacctgtttattaaccgcccaaacttggtgctcagcacaaggtaggtactccataaatgctattgaactgaccaaagtggggcatttgcgtgctgaattaaccttgtactcaccattgttatagagctcatatatttttatccaccacagctttgttgaagtcacagattcacaactgttatgccaactgactattatttctagacacttcagtgaggaacttatgggacgataaaactagttcagtcatatcaagttctctcctatttcacacatccataacctgaaaaaaatctcagtaacaaattgaagaacactcttaactttatagtcaagtaataagaggtaaggggtccattgtttgccacaagtacccactcagataaagtaggtcatctggagtcagatgttagagccccaggttcagttgcttaatccacaaattctcatgactcttatccttttcaacagagttggagttcccaaaagtttagaaagtggaatcatcagataccaatcttctctaccagaaagacaaaaggctttagacctgttaaattcagaggatgaggaagtcatcttttagttgtccactgtgtagaaacccttgaccttataaattcaagcatcccccatgtttcaggcatcttgagaaacccttacacacattattacactatccagtttgtaattgtctccctcaagcagataccaacaacaattgacatatactgactcaacatgcaccagacatgaacatacacacattacctccattatgcaatttaatcctcagcaaacctcacaaggctgatttagtccttatctccattttacagatgaagaacccagggagctgagctgggtaggtaacttgctgacagtcctaccaacaagaaaccacagaacccagactcaagtcccatcaactctgacttcagaggccatgatcacacttgcacacgttactgcttcccatgtagtaaggtttacatatattatctcaattaaatttgagagtgaggaaaagttattttatatcaacatgtaaggggacaataaaaattatttcctgtggttgtcttagaagcaacaaccaactcaaaatagggccttgaacactttaaagaaagaatgtgacaacagagaaaaaaacatcgaaaaatgtgaggcagacacacaacattttgcagtgaccacccagttctacccatgggcatgtcaatcactacagaggatgttctctttacaggttgtactaacttagcaagacttcttattacctggagagaataccctttatttctctaattccatactcaaaaggtacaagaatataattataaatgtaacttctgagatatcttgaatataacagatttcctaggaaaaaagtatgtaaacattctatttctttaaaagggacatcctcaattgtaagtattgaatgccatttgtcaatattgtttcacatgaacatagcttgtgccaatgaaattgttatatcattagaaacctggtcatttctagatgaattaatcaagttcggtttctatgttcactgggccatagaatagatgtgccatagtaaatttatgaagttaataatattcatttctgaggctatttggcagccagttggctttttcctgggtcacccactctcccttaccatgcctgctttcctccaactgcaaagcctcacgagtacttataattgccccatcatacaaatgagaaaaaatgatgctcagaggggttttgtgacttgcttagctctgcacagctggtgtaatagactctacagaaggacaggaaaagaagacatagaagccaagaatgaatgaggtgacctgggactctgctctttctatttgccaccaactacagagacctcaactgacatctccagccctctgctttcagtgccggagtagagattgcacactggctcctgctgagagctttatttcttattctcacatctgagcagttaaaaatactttgaaatatgtcacctgccttcccttctatccttgccttttgcttgctttttctcttgcctcgctttactaaagcagcaaaagcaagaggaccattaaaagcaagaggaccataatgagggtaagagtagtgggaggagacacagggaccctccaccttgcttctgaacgaaagtcataatataatccttgctttaatctgtattcagttctctgtcctctgcccgcatgctgacaagatccactttacctggtatttttagctgatacttggcgcgatgtgctaagtgctggccatggatgctgctaaagtgacagcatgtgttccagcagctccattgccatggtcagtcttttcatagttcctgtttcattaatgttaagaaatggctcttccttacttaaccaaatgtcagcagacacagcttcggcccttaatcatccatccccctgcccctgagggcatcctatagattgaaggacattgagactgcaggctcagatggaaaaaaaagtaatctaattgcctgttacttaacaaactttgtcttgatggagtattcattgcacacataaattagactgcctcaccttttgcaatgtaaaatcctggaaataatgctagccttcattctaattgtttttaataaataaattaaagaattaatgtgtacttacctggaacaaagcttccctggaccacctccttgtatgcccaccagccttcatggatttttggtgaattctgttgagctaaaggaaaagcaaagaagagagattaagatgatagcagagaagcactgtgtcccggctgtccgagtaagaagggtgaatatccataaaataacccttttctaccccaaagtcatactacaacagaaccttccttctcccttcccttttttttttcaaatagatcattgatcggtaaatataaaaacatttttattgaaagttctctgatattttaattgatgttaaagagatagtaattatgtatttaagtcccctgctacctgtcctcatcatcttccccatacacacacacacacacacacacacacacacacacacacaacacacacacagtgctcctgctgaaactgaggagacagtaggcagatcccatccatgtatgtccatggaacccttgttttgggagagattgaagtttgctgagggagccagtctggaaggctgaaaggtatacccagccagctttccttaggtcccaggaaaatgaaaacaagaatataaataactgtggtggaggtttttgacatcacaggcaaaaagggcagagggctcaagatattggaaaatatcgtggagatctgtaagctcatgctgacatgacctcagggaaacccttgaattcatgacagttgacaagtgaattggggcaatgccattacacatgcacacaaaccccaaagtatacatgatacataaatttatgcttatccctttattaaactacattcatatttcaattcccagacacattggaagaaaataagtgaatcaatcatatttgtaatttggctactattaatgttaaatcttaacttttttcttttcttctttaaatctggtgggggtttttttccagccttcctcttcaaagttctagggaaaagactcatcattctgagttagaaagaatgggtataagacaatgggtttgaatgcaaggctttgtatagagagaagatttactagatttctctagtttccagataagcttggactgtttagcttcaagtctcttcttatagtatagtgaagatactttttcttcctatgatattaagagccctgaggcttgtatctttgtggttgaaggagattttctgacataggatgagtgaaactgaagcccactccttctggaactgacagtgggcttaggggactttaaaaacaaataaaagagagacaaagagcttatttaagactctggaaaaaataacacctttaaatttgcccagcacaaatctcaggcatggacacacaaaagtatcctggatttcctggtattcttattgcccctgtggtgtggatagagttcagacatttccatagcccttgaggaagatcccgaggtcagctgagttggaagccaatgcatctgctctgggacagcaggcaaaggaggaagtcacctcaaagcagaagccagaaaggttctgtccaaccagggagtcaggcggaagattcaactgagactctgggaatttgcagcaccagggaaagacaaggagatttgaagtcagccaggaggtctttagacccgaccaagccaagaaaccaaatcaaggtttggatatggctgcaaaattccccaagtgggtagacaacatttctctagagttcagaaagggttctgattcttcctctgggtcttggtattgcctgactcaccctccttctcccccaattcgttagacagtcatcataggagccagaggagaatcccaaaggcttagaaacctgtgagatcagatatctaatggccctcttatgaaacaactactttgtaatgctcaccttgagtataattaaataaaattcacggacagtacaacctactaaaaaacaacaacaagaaaaccaaaccccaaacctgataattctctaaacttcagcctagctctgctagacatgtaaaatgtctcaagcctgggaaaaatgcatgtttctaagatcttaaaagcattgaactataaacatcacctaacagttttgcatcagagataagccaggactggttttccttacaacaggcaaaaacttcagagttttataaaaactcacaccaagttttatccagtcaggattactgactgtcatcaaacaatttaaaccataaatccagccttctctctttattctacgagacagtcattggggaagctgcattatcttgcatgtgtttcattaccccaaataaatatacacttagcactcaaattttgttacattaagctttttacctaattattttacaaaaaaatttttacagtgtttacacatcactttaaaaatttaatgtagtgctttaactataaataaaagaaatgtaatttataataatatatatttcaatgtgaaaatgcttgagtatgatacactagaacagagattggaaaacttgtgcctgctagccaaatatggcccattgcctgtttctgtactgcacaagagctaaaaatgaatttacatttttaaatggttgaaaaaaaagggttgaaaaaaatgttttgacatgttaaaattatattacattcaaatttcagtgtccataatgttttattgccaaatagccaaacatatttatttacatagtctctagagttgctttctcactacaatggcagagtggaatagttatgacagagaccatttggcccacaaagcctaaaatgtttcctccatggctctttactgaaaaaatttgttgagtgctaatttacatacataatttcaaaaggaaaaacaatcaatataatcaatatagtgctttaactataatacaagggggaaatacaaggaacataatgtaaaacaaaatattatatatttcaatatgtaaatacctgggcatggtgcactagaagaagataaaatgaagaagttggatgcttaattaacacagacacaaataacaacttcatattatattagagattccagaatccacaagtggcatttctctcaatggtatgtggttttccaaaatagtgaactcttgggaaagattagaacacaattaagtaccaccttctcttgatttacatgatctttgcattgctaaagaaccaggtataataaaactttgtaagacatgctttgtgtgtatatgcaaaatggagtttgattggagggtcaaataaataaaacagtttttccaatcacttgaatgtctgttgggacatgggataatttatcgttgtttctaactatctaatatgttgcagagcatagcatctctgtccccctttagttgttgctaattgccactctttcattataacaatcttaagtgccctcacccatttccaaaatattcccccagaaacggtgacatccctattgacagtcactgacctaaaggtgctatttatagtacttacatgtgctaaaagaggataaaatgaaacattatgttgaacactagaggatagcgctttgtctaagtagacaaaagatacatctttccccatctatctgaattgtagtgtcatatggaatacatttgccaccccattaccccattatatgttcaaatattttttctactctttcctgccatttgaccatatcattaagaaactttcatttctacaagggataaagcagtaaggaaaaaagagaaagcatacatgcatgttgtcaagacggcaaaaaagggaaagctaactctaataaaacctgagtaagatgactaggttctcagatttttagatgcattcctagtccctctttttatctctcttcttacatgtgcatatcttccacactcccctctaaggacaacctatcagtcgaactgaaatatcaatttaagaaacatctatctagaaggaagaagaaagaagcccctgggtaagtaagagtattggcactgacaagattatcaccaaaagcttctgttccatccagaaagttgcaaaacactttgctctttcttcatctccaatcattgcttctttggctatcacatccattcagaagcagaactatgtaagattttagcaggtaataagacaatcagaccatctgaataaagcctattgtaatagtagaactgcagagctcctgttagctgtctttgatgtgcattgtgaagaaccaaattcaccctccaaaaatcaatcagctggaagagcccatttgatgtctatcaattacaaaatttaatggctgcagactagaagaaaataaagatgatttatgtaatgttttcaaattcccttggatgctcaggctggcctcatactgtttggtaatttagaaagacaggatggcacatttaaaaaggtacctcacttaaagttctgccacagtactacaagaagtttattatagatggatctcctagagaaatacaggattcttattttaacgcctcccaccagatccttggtagtcatcttgttgttgtttacatgtgatttgaagtgagtgaagagctgattgagaattcctcagagcaaacaggtgaacagagagccgcctgagcttttacagcattctatgctcctctttgcctaggtatggatcagaattttttaatgtgcaaccagcccctgggaaaaatccaggtgtctaattaaaaaaattgtgttgacaataaaaattgtcatcactgccagaggaaaagatatacatagcaaggaaaaatctatttcagttttattcttggtttatttttcactgtggcagtttgagaactgatgattttccaaaggaaactctgaatctcagaattttgagagacaatgttcattgctccaatggcttcttatacaagtgagcagaattatcttacataattctacttctgaatgaatgggatagctgaagaagtcatcgttggggatgaagaaagagcaaagtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcaggggtgtagctgtgtgccagtacaattttatttatgaaaacaaagagctggatttgatctgtaggccatagtttgctcagttctgtcttggatctaaaagatttttgttatccagttctgtttcttacttaaatgttcagaagtgagctactttacaaaaaaaaaaaaaaaatcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgccaaccaacttaaaaaattatgttcatatacccactgaccacaaatacaggcatcacaccaacaagtctttggatccagactaaaacttcccaaagatgatgtgatctggcctgtgagtagatccctatcattaacagagcttactgctccaagtcaactaatttaactaacttaggttcagagaaaacataactgcgaaatacctccatttggaaattacagtggtctcttgacctggtgggaaacaagacttaaaagcaacatctgagatagcacagttgaggtagggaaggaaatggtgcaatagggaacagaagagccctcacaaagggatccagttggggaagggatgttgcttaataaaactccaccatcagtcaaaacataccaaaccataagcacatacattgcaaaaataagcttccaagccctgggtcagtacaattatacctgtgccaagtggtctacaactagcaaagatgaagccagatatagaggagaggcagagtacatacactgctatggttacttcattttaatgtaatggtagaagccctgaatggttgtttccctcagaaattgcatttctccactggaggaggtaattcaaggaggaaggtaccaagtctactgaccaggaaacaacataagttggaaggtaaaaaagtacttctaacattggatgcatatccatgacatcacttctttccttgcatggccaattttgtgttctaagtgggaagcaggaacattgagaagtgcatggatcgtcagaagaaacataaatgactgccccattgagctgcatggcactcactagactaacggggataatgcccttcctcaggtggttgacttttacaacacccggaaggtatttttcttctgtgcactctctgtattatgtgtggtcctacattctaacatttagatagtgccccacactatctgtttccatatcattcatttccacctaaccgtaaccttcctgaggtcagagaatatatcttattttaaaattccattatttggccgggtgtggtggcttactcctgtaatcccagcactctgggaggccggggcacgcggatcacgaggtcaggagatcgagaccatcctggctcacacggggaaaccccgtctctactaaaaatataaaaaattagccgggcgctgtggcgggcacctgtagtcccagctactcgggaggccaagacaggagaatggcgtgaaccggggaggcggagcttgcagtgagccgagattgcaccactgcactccagcctgggcgacagagcgaaactccgtctcaaaaaacaaaaacacaaacaaaaattagcagggtgtggtagtacattcctgtaatcccagctacttgggaggctgaggcaggagaatcgcttcaacccgggagacggaggttgtagtgagcagagatcacaccactgcaccccagcctgggggacagagcgagactccgtcaaaaaaaaaaaaaaaattccattatttatgcaaaagcttagtacataataagtgccagaaaaatattgggtgaatgcctgataaacgtggtagtgaagttgtatattataccaacttgcagtccagctcacacaatccttgggaggttttagtctctatccaaagacttgtgggtgtgacgcctatatttgtggtcagtgggaatgtggacaaaagtggtttcaagttggttgacaagcccacacgtgcttgacagatggaagagtaccaggagctgacaccctgcctagggaaatcaaagccttagcaaacccacttttatttagcacaatgtgtttcatttaaaagcaaaggggaagatgtgtcatacctggaactatttacatctctgtctttctttgcttttcctgaattcgcaagacaggatgaaactcatttctatctctccatcctatgtgaaaaccccacttgccatacaaactagacaggacactcagaacattgagaattgaactggttaatgggtgacaaagtgactatttccaaagagagaagatgggtatgacctagaatcaccttgcgtgttggaccagacctaagcaagctgacaaaattatatttgtgttgggagataagaaaaaaatattgatggcgggtagcccgtattactttcatctaaaatgcttagcatgatactatttttaagaagttcaaggccaggcgcagtggctcacgccactaatcccagcactttgggaggccaaggtgggcgcatcacgaggtcaggggatagagaccatcctggttaacacggcaaaaccccgtctctaccaaaaatacaaaaaattagctgggcttggtggccggcgcctgtagtcccagctactcgggaggctgaggcaggagaatggcatgaaccagggaggcggagcttgcagtgagccgagattgcaccactgcactccagcctgggtgacagagcgagactccatctcaaaaataaataaataaataaataaataaataaataaataaataaataaatattaaaataaatagagagaagctcaaaggtaactagacttgaaaatcatcaggaggaaagtccctattatggctaattctcagcctagtattctagaatttctgcaatttgggtttaccacacatttaatatcatttctcataaaatttacaagagtcattcttcctgctgtccccaggtataccacgtttattactctctccacaccttcactctgccctttttccccccgaaattccttctttgtctactttttcttgacctggtcttactcaattctcaaagcctctccaatttacactcctttcaagaaaggtgtactgatcattccaactctactgtaatccctaacttccctgaatttcagaactttagtgtctattcctcatttgccattcctgttaattcaagaaacatctagtgagtacctatgattgtcagtaagtattctaagcattgagggtacaaagttcctgttttccatgaagttattaggtgggcgcaaaagtaattgtgggttttgctgttaagtaatggcaaaaccattaacagcaaaacccacaatcacttttgtgtaaacctaatacattctccgggagggagacagagaaaaggaaagaactgaattcaaatatataagaaaaattggagaaaagtactctgtgatatagagggtgaggtagtaaagtgactagaagaacatatgagattgtatgacagtgatggtctctgaaattatgacacttaatcagagatttaaataaaaataattggcttcatgaagatcagcagtggtagtatttcaggtggattcaaagactgaaagttggcagaaataagtttggcttctttaagaaaactaaaagtggccaataggtgtgataatagtagatacaggggagaggcaggctaaaaatgaggccggacaatgtaagtagcggcccaagagaaaggtggtggtggcttcaactagggcagtgctggtgaaaatagaacatcataagatttagatgaagcggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgttaacctgggaggcggagcttgcagtgagccgagatcccgccactgcactccagcctgggcgacagagcgagactccgtctcaaaaaaaaaaaaaaaaaaaaagatttagatgaagcatggataagacttggtaatgaactggatgagagaagttgaagacttctctcaaggaaaactcccaccctttttagtctgagtgactagatgttgacagttactgagatgaccagggagactaagggagtaatttgggagcatcttcagtctcctcatggctgcaacactttctttgtatatttttaacatatattttgctattacttctctctccctgactaaattaaagctgtctcaagggtaaaaatgttgtgctttgtcttccataatgcaacacatatcgtaggtacactggcacagtgtttgacaaatatttgcttaataaatctaggaaagggagaatgacatgtgaacctccatttataaatgttatttacaagttttatagaaatattcactctgatgactaccctctatgatttccttggaataagtttaatgataaaaggtccttagaattcaaagaagagtgtaactcaataatagtggaacacaaaagaaaagggacaaaaagattacctctaatctctgtaattttaagagggtaactataattttgcttctttcaccaaacattacgtcttgttttttcattcttatttttaatgtacagatactagttattttagtagctatgccataatttaccaattattccttccctattggttatctagttgtttgaatactgcacttaaccttctcaggtacaaagcttccctcactcatcctcttttagacctttctttagcacagtgagccaaaatcacagtcaagggacagaagtatatatgttgagttactttgtaaaaaatgttataacaatctgcattgccacaaaagtataaattattatttctcaaaggaaaattctggtggtactttcaggataactacataataaaataatgctaaccatttaaatataattttgacttctgacaaataggcaacttaagaagcatcattagtctaatgaatgaatctgttctgtcatcagctcatgagatggacatttcatagaaatctattccatatttttactattatttatctgtttggaatcaggtatagatttattctctgtaaatattgtagctcctttttgtagtagagtgtatttatgtttttaaacagatggatgaaacttcagatcccaagagtacaagtccatgcctaggttcatgcagcctcccataaatcatagcaataaggaaaatgtgtatgtgctatattcagaatgctaggagcatactaataactccatttttaaactacaattggaaataaactactggtaattcctaaaatcaatgggtcagtcaattgtggggttaatctcatgtcacataaaactttctattacagctgaaatctctgaatgagactaaaatctccttgtatctctcttaagcttgaattcagcaaggctaaatgcaacgaaaagaaagaaatccagcagaattgttggtttgggaggcagtgtgaaatgatggaaaatacatggcaccctggggttaaatcacaaatttgctactaattgtgtcactttgggcgaattatttcatctctttttaaaaaatgtttatttgtataaatttaaaaagtacaaatgcagttttttaaatacagatatattgcttagtggtgaagtctaggcttttagtgtaaccctcaccttaatgggtatattatactccttaaggaatttcccatccctcatccccctcactctcccacccttccaagtctccaatgtctattattccactatgtccatgtgtatacatttatagcttatagctctcacttataagtatttgtgatatttgactttctgtttctgagttatttcacttaagctaatggtcttcagttccatccatgttgctgcaaaagatgtgatttcattcttttttatggctgagtagtattccacggtatggatataccccattttctttacgcacttacccattgatagagacttatgttgattccatatctttgctattgtgaacagtactgctataaacatatgaattcagttatctttctgatgtaattatttcttttttagagtagatacccaatactgtgactgcagattgaatggtagtctatttttagttaccaagaaaactcctctaaattgtgagccaacttgtggaagaaaaaagatagccctccctgactgaaaaaagacttaaagagcctctgaggacattcgtgccatttgtgagtcaaagtacagtcactgaagaaacttggggaacagaatataagacttgcagcaggaaaaaaactgattcagggaactcatgcaggaaacatgtggtcttcgctgggacaaagcccagagaaagcccaatgcccggtagaaaagtaggcaaaatgacctattaagtcaatttgccatggtgggacataaagccacatgcaaaccataggaaaaggccagggcagatttattttttatgtatatcatagctcaacatagttttgtccttcattctgattctgatccacacagcatttgctgagcatgcactatatgacaggtgctgtcacatacttataagtggtagagccagtgaattatgaccatatctgggctttccacaagccaaactggagtttcattatataaataaccaagaccaaactaaaatttggaacttgaattgtctggagagttgtatctgaggagatttgaggaccatccctatctcagctactacttcaatgaggatgattctcaaatttatattccccacctggattttttattccagttccatgcaagcttttcagcagcctactaattagaatactgctattttccaggacctcatgatcacaactgtcttctgcccctgtggcaaaaatagtgctactaaatctcccaatatttatttccccttcttccttaacaaggaaaactctggttttagtaagacatcacagaatacagactatattagccatatctcctttgtaggtaggtgtggacatgtgaataagttctggttaatgagatgttagaaaatgtataagagttccaggaagtgctaaaagaaaatgctatgcctctcctcacctcttccagcaagccgggatgtggacatcatagctagacttcaaatagccatcctgaaccatcatgcaaatgccttattttcagcatcaagatagaaagagctgggatccctgcatggcctacatttataagatataaataaatctccatcttatttagacttatccatcactcatagctgaaactaatcctagctgatacacacttgccttcaatacccatggagtgaagacattgactctacttctgctatagctctaatccattctttccttcacatttctactgcctagacacagatcctagacaaaggccctcagtgattacttaaatggccaattatagtggcctaataactggactcctatgtccatccatgctccctgctgtggtcttcacacctcctgcatgattatgtttcctgtttacagcagcactgtgtccatgtcgtctttcacttttgaggggtagtgaaagacatgcacagagtcttcctatgaagctcatttaccagctatttacacagccaggtccaaactcattgaccatctttcaagtctctctgcaaagcccttcaatgactccctattggttacacgataatgtgcaagtgttccaatgaaactttcaacaaactgtatggtgtggttaacttatctgttttccaaaactcatcctatctcctttgggcatcttttctctgtgctctcatggcatttattatatacatttacttataacatatatatttttcttaaataacctcttcatgagattgtcctcctgtcagaataggtgccctgtaaatgtatttggactgaagtaaatttagacatttgtttctcactgaccaaccctagtcagactgaactatctgctcttggtgatgtttgccatgtgttcacactatttacttttactggaatatcatattctttactgtatatccaaagtaaaccaatatttcaagtgtttgctcaaacactaccttctaaaaaccttccgtggtttctccagataaaagaaagctctattataatctctgaagtttcttaccatattgtatacaatttatttcatttcagtccaattcgatatgattcaattcaatcaaatccagaaaatattaatatttagaacatactcattatgtttgcatactcattctaggtctttattttggagtggtttacagtgcaatgagaaataaggggatgtctttaatatattctaggctaaagtgtatgcaatatacaaattaagataatgatagtgttgacaatgctagtttacctgcgagaacaggcaaactctaaaatctcaatggcatagtacaagtttatttctcatacatataaatttccaaactggttttcctgattggcatatagctctccaagtcagggcccaggtttcttctgtcctgtggctctgctatctgcaatacaagacttcaaaggccgctatgctgtgtaggtcaagccagaatggaaaaaagcgtggaggatttttcaaaagttgttttcctggcttaaacctagaaataatattcactacttctgcccacatttcattgactagaacttggcctctttaatacaactaaatgtaaaaggaggctagggaaatgtagtccagctgtggactacacagtggtgttggattggatagaactgagggaagtcttgtagaatccctcacacacaatgacactgaagagaatttgaaagttttccactcccttaaaatggaccaagaagaggagtaaatattttttggagaacatgcagccagagtggttataacttctaatttgtctagaatattctatttgcatttgttgtcccaatattgttataaaatggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcctacaacctatctctttcccctgctttcttactcaccatttgccagccaataagtcaatacaaacaactcaattggctacagaagacacaattactagaaacctgatgacccagataccttttcttgtaattaattaattaattaatttttgagacaaagtcttgctttgttgcccaggctggagggcagtggcctgatgtcgtctcactgcaacctccgcctcctggattcaagtgattctcttgcctcagcctcctgagtagctgggattataggcgtgtgccaccacacccggctaatttttcatatttttagtagagacagagttttgccatgttggccagactggtctcaaactcctcacctgaggtgatcctcctgccttggcctcccaaagtgctggggttacagatgtgagccaccgcacctggcccctttccttgtatttaaatgctagacaaaaagaggcaaatgtcaagaaagtaagattagagaaattaaaggttcagtggtagaaggtatggagaatggttccttcttccctgaataacttttcttcaacagcaaatattcaacatgactccctatgctgtcttcaattctgttctatacagtgagaatagctgccggaatgagttgtattacaacatattgaatataataagttgtaattatcttatacagaaattatttaattacatttaattttctcctaaatatgaaacagcatgttcagaaaaatgaaaatacaacatagaattatacatgtgaaagggagatttaagacagtgttttatgccccccttatttatcagatggggaaacagagtcctagaggaataaaaactttcagaagagttaacggtagaagccaacactatgaggtctctggtgaccaaattgctgctctatcaactacatacaaaaggattttaaaaggagctgaaggccattatccttagtcataggaccagaacaccaaataccacatgttttcacaagtgggagctaaatgatgagagcacatggacacatagcagggaacaacatgcactggggcctattggaggatggagggtggggaaaagggagaggatcaggaaaaacaacaaatgggttctaggcttaccacctgggtgatgaaataatctgtaaaacaagccctcttgacacaagtttacctatgtaacaaacctgcacatgtacccttgaacttaaaaaaagtttaaaaaaaaagtcataaaaggaagaattagttgtcagctaaacagaacatctgaattcagttatttaggataattagttcagtagtcagcaaactccaaagtttttaaatatcacatgcagtcattctacctaagaaatgtgtaacaatgagattctgtcttgttggcttatagaaaagtgactctagaggagtatgtgcaccctgtataggaaaattgagtggaagaacagtttggcaagctcctgggtcacaagttacagtaagcaccttttgttcttccattattcacctccagcactctaccacataacctcaagatctactcactttgtacatcaaagacagattattacaaatgaaaagaatgaaccaataggaactgctttccttgagatccccctctaaaagttaatctttcaaggaacaaaggaaaatgcacttcaaaataggcattttccccctcaaacaataggttttctcaaatttctgagaatgccaagaacactgtgtttttgttataaatgttacatgccagcatatgattacaaaagcaagaaatgaaaagaaaaaaacccttacactttttaaaatcacaggtgaggcagatgccatttgtaagagctacaacatccttaactttcagaaaagaaaaaattaccaagcacaaaagtgaaaaatacactatagattatatacaaatctgtcaataaaatgctttcatcatggtggccaggtttcacagattatgctttgtttagaaagtaagcaattccatcattaggctaatgctccacagtgctacaattctacttcctttggaacaggcaggatcatgtaatcacgaatttcaaaagatgggcaaaaccagacacagaaaacgttccacatgctactgatgcaaatgttgtactctaattttcaaggtcaaaaagataggataggaagattacagaagtgtgcaagaaatacaccaatattgaccttaactgagtttttgtgtcactatgtgtacacttactatggtgttcaatgaaaagatgctggtcttggtgagtgtacaatgtgtgaaagtgtcaccacagggaccaagggtgggctggcattaggtcttggacttgagttggattccaaggttttcttagcagccaaaagttagccaagagaagaaataaaaatagctaacatttaaatagcttttataggaaggcactgttctaagcattttatatatgtattgactcattaaattcacatcaactctcttttgtgttacagtattcctgccttctctgcaggggattatgttccaagaacctcagtggatgcctgaagtctcagatagctggtgactatttatactgttttttttttccctctatacgtagacacttatgataaagtttaatttacaaattaggcattgtaagacattaacaacaatagctagtaaacaatagaacagtgataatatgaaatgtatatatattttatatgacatttataatatacatattttaaaactctcaaaactataaattttatgcatgcatgcatatgtggtaaagttataaaaccatggatacatattaacttggagaaattggttctctatcttgagaagaagggagagatggggaatacaatttggaaaggatacacagattactaaaattttatttatttgaaaatatcagaaacaaatatggcaaaatgttaatatttgctattttagaatgatgagttattagtatttcacgtattctcagtagtttttccagtatgcttaaaagaagccatgattttaaaataggcaaggaaaaataggtatagttgtaaacaaacaagttattaagtaactgtaaacgtgtttttaaaaattagctagaaaaaagcaacctcagaagggaagagtaagatagataaatcagtaagatagagatcagtgagaatcttcatagttcaaaagtgataggccaagtaggcgtcaattcttaaatagatgtagttttaatgaaatcctaattcagtaacattaagggattcttcagtaacttaaaactgtttccaaaattacatggaagaacaaacaagattttttaaaaagacttacttgcagagatatcaaaactttataaagttataataactaatatgatgaggtattgataagtaattgacagatcaattaaacagcattgatgatgctgaaatattccctagcatatttttgtataagatataacggtgtaaatatcaaaatctacagcaaagaagtggactatttaacaattactaagaaaattggctaattgtaacaaaaattattatatttgtcataatatacatcctggatagatttaaaagttaaatgtaaaatgaaaattttaaaataggtaaatagaatataactatttttttctgtaaatacagcatctttaagttaatgtaggttcctctttgtcctaaacctaagggttttttatgcattctaggtagaccagcagtctaactctcacagaacattcagagaaattaaaataaattctgcccacacccctacatgagatgaactggaacgtggtgtaaaactgggttacagatctatgtagattatctgatgatctgggcttctttaaaggaaagataagtggataccccagggaagttaccatgaaccaaggaagacaaagatttatgtaaatagctgctgactacacactctttttagtaaacttacaaataacaggattttgaacaatacagcattagctaaatatattatggaacactcacactaagaaatattaaataatgttttttgaagattatgtaaagacagaaaaatcctcaccaaaaaatactatctgaaaaaaatcagcatataaaaaagtatataaaatatgatcctaattttgagaaggaaaaaatatctggaaggaaatacaaccaaatgttaagtgaggttattttcaagtgttatgatgatgaagtgaagttaattttctaaccactattttccaactttttgtaatgtgtattttttatgattaggataaaaatggtataaaaatttttaaaaaggcaaaacctcccactgtgtgctgagcttccccgaaccagtgaactagatttcactgaggaccctaacaacttctcagtggtaaaaataatgagttttcccaacattaagatttaattttcagtggtatagatgggagcaagaaagcccaaaggacattgaccgtttctgagcctaatttctcactcccgcacattggccactgtgctgctggctaaacaatttccccccattctcagttactcgttttgctcatgcataaaagatacatgttaaatcagagaaaccaccctaagggtgattgatgaggaggacagcctggagagttacttcaagctctaagctcagggaacttggtaacactttggactcaattttgatttgcagttgtacaagacaatgaacattgctgttggagggggaccttgctgtatacactagaattcaatttagcaggaaatggcaaacactttagggaacccaaagaccatctccatgatacagggtttcctaagaggacttcctaagagggctgcacaatgaaacgaatgtgccctggaaagacctgctttctgcatagccagtgaggttttataagccatgggtaaaatgggataaatgttacctttgaaaagtatatgccgcctatgctcttcacatagggcttctaaatcactacacaaacttctacataccgatatatctttctgtgggagggatgagttaaaacaacctgtctttctctttctctttctccgcctgtctgtctctgtatttgtccctgtctccttctgactctctcctttgtctgtttctccctcttcgtgtgcatttctatgagtgtctgtttgtatttttctcagtgtctatctctgtctcattctctgtataacattccttctttcttgtccacagaattttttcttaaaagggaaggggactaatatagcatttactttttctggcactatgttactttatatacactatttaattcaagccattcagcaatcctaagaggaggaaaaacgtttttaagaaaaaaccaaaaacttttcttataaatcaggaaactgaagcttacagaagaattttgtccaaaggccacctattcacagaaaatggaagatggctgttcggtaatgagtccccgtggaccccggagtaacacccttcttagtatgtggacatgcttgcagagtgcaccttctccgtgatacaaggctattcttcctaatccatgggctgggaaatccatggcctaagatgcaaactgacctaacccacaggtataaaggcagcagagcaaccagccctccatccttcccacctccattcctttcctgccagctctctttttcacttcctgcaacctgattttcattcctgagacaaaataaatgtatccttcacagagttttctgatgttgaggacccaatgtccttcactcagtccttactgtacttgctctctgaggattgaataccatggagctcatcttcttaaactgctttttccttagcttctgtaagataatatggcatttgatttctatctattctctgtaaaaaataaaaggtaaaataatttgtctatgtaagtcctcacttaatgttgttgataggttcttagaaactggaactttaagcaaaacaacgtatagtaggtccttcaataatatcatttccttcaatgtaatgttttatcatgttgacgagaaaaaaaattggttttgtttatatgttgtttcacttaaagtcagtttccaagaatctactggtaatattagtgaggacatactgttcatatatgtatatatgtgtagatacatatgtacacatacatatatcagggaagtaaagaggacatagttggggaaaccaagcaacatagagatgggcacatactagctgcttaatatattaatttattgaattaatgaattaaccaactcatagaattatctcccaatcttcatctaagcaaatctttcactccagccaactagaaaagtgccccctataaatgcaatgtgttttcttgctcacattcatagacctcatctgaggtttttccctctttgtacaaatgctatttacatcctgaccgaaaccatcaccaacccatggaaaatctcctttgttgctgtgaattgaaacaactcttcctctctaaatgtttatgacaatgttcacctatttagcaatttatcctttgcttccctgtggggtttttaatcatcacttaacttttgtgttgttatttcactcctctcttgttgtcattgtctcttcaactaagagaaccatacttttgtgtcttcattgtgcccctctaagagaagatgctagtataaataaatgtttaatttattaatattttgaatgcaagagaccagtgctcctaagtattgctagcttttatgcagtagaatggaaaagagggcaataactaaattttctgagagtctcctctgtactagatgttttgcaagtatatcttgtttcattctcaccagaaatttattaggtagtttttaccttatttatacataaagacactgaagttcaaagttacttgatcagggtcattcatctggtaagttggaaagctggggcctgaaagcaagattcagctctaaagattacatccttaagatgagttcatgtcctttgcagggacatggatgaagctggaaaccatcattctcagcaaactatcacaagatcagaaaaccaaacaccgcatgttctcactcataagtgggagctgaacaatgagaacacatggacacagggagcggaacatcacacactggagcctgcggggtgtgggggctgggggaggaataacattaggagaaatacctaatgtaggtgacgagttgatgggtgaaaaccaccatggcacatgtatacctatgtaagaaaactgcacattctgcacatgtaacccataacttaaagtataatttaaaaaaaacctaaataaatgtataaagcaaaaaaaaaaaagattatgtccttaaaattgtgtcacactaaacaataaagtttctagaagaatacataggaatgtatcgtcaggaaactggagtaagcaaaggcttcgttagcaggacactaggggaaacaattaattggacttctttaaaattaaaaacttctgttcacctaaagatatcacaaaagagtgaaaatgtaattcatgagttgggagaagatatatacatccaggcaaaattattgaatttagaatatactgtatccaaaatatactcatacggtatccagaaatactttaaaacttaatagggaaaagacgaagtcttttgttcatttatgggcaagagacttgatagatccttgataaaggagaatatccaaatgggcagtaagcatatataaacttgctcaacactactcaaatttaaaccccaatgaaatgccactaccaccaccagaatggctaaaattaatacaatggataatagcaagtattggcaggaatgtggtgcaactggaattctcatatactgctggtggtaatataaattagtatagccactttgaaaatgtgtttggccttatcttctacagttgataaaaactacaaatttcatctactctatgacaataatttcactcctaggtatagatgcaaaaaatattagtgcgcatgtctactaaaacacatgtacaagaatgtttacatcagctttatttatcatagccaaagactgaacaacccatatgtctactgacaccagaacagagaaacacatttttgtacattcatacaatggcctacaaattacacattaaaagaatcaacaattcctaccttgaacaacataggtgagtctcaggttgtagagtgaaagaagccagacacaaagagtacattctgcatgatgttatttatatgaagttttaaaacaggcaaaacaagttcatagttataaaggtcagaatatttttttcctctattgggtgagggcgaagggtgttggtaattgactgggaagggatgggggtgaacctatggagtgatgaaaatgttccatattttgattggtgtgatagttatgtagtatatacatgtgtaaaattaattcatctgtacaattaagatttgtgcattttatatgttaatctcaatttaaaaagcaagtaatcaaccaaacagcactctgtcatggcaaatggaaatatatttgtaactataccagtttcctgaataagaatttatatgatctatccattttatattaataattaaggtccaaggaaaacatttgtctctcctgacactctggtaagattccctttatcagataataaaaccatatatcctgtcctgtctcacctgtgtcaggaagcacacacgaattcaatactaaattaatcattttagcctgggttttggtatatttactttcattctctctttctgctcctcactccccaaactccagcctcacttcccttctgatgaaaatgttttacgtatgccgttcagtacctcaaaaccatgttggatgtaggtaaggatataacatgacgtgctaaatgaacaaggtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgtttatgaactaggatatcccatttttaaaaaatctagaatggatgctgagaagcaggattgcttaattgtagagtatgcctatcttggaacaaattagatctctctaaagtggttataacaatttaaaacacatcttttggccacagttggtataatcacatttttaaatgtgtgtcaatagatgggtttgtaatggtatgctactgcaattttaatttcccctgaatcccagtgaggctgaacaaatttttcatacatttatggctgttggaatttacctataaacagtcttgtttatatattttgtacatcaaatggtttattagactgtttgaataattctggttccagaacattttacttctcccagaaaagctcaaccaatttctcttgcacttctaattttcagaagttttttaaaattgaacccaaatctgtattgttgatatttctatccagtacactggttttgcactctgggttgacacggaataagtctgacctttctttcatatcactgccttacatatccatttgttcattgacttattcattcattcattcacatacttactcatttattcatttcagcaaacacaaattaagcactcaccaaagtcaggaataaaacctgggtcaagtcatcaaggagacacagtttgatagaggagacagacatcaaattaactaatgatacaacatggtaagcccagtaatagtggtatgcacaagaaacaaaggtaggacagaatgaggatgactttaacagatattcaccctctcaccacaccatttattaaaatagacatttctataaaacttgcctgcaataagtatccactgtcatagtcctcttgtgtatctttcccccgtcacctggccactcttccagcggaggccccccaatatttctatatcaactaagggggtggcagggtgtgggagatacaccaggaccttatgcctgtgctgcagctggcctgttttgatgggttggtgcccagaactgctgttacatatttgactgtcatatttggaaggagctactttcacttgtgtcctggttacaggtattctcactgtcccaatcactctctgtcacatctatctttatccttcatacatgatagtgctcagaacaatacataggttcatggaaaaatagtctaagcacagtgtttatcaaacctcagtgtgtgcatgaaacatctacattttttgaaaaaattgtggatatgactcagaaggcctgggctggggcctgagattctgtatttctaacaacttgcctggtgatgccaatgctgctagtctgaggaccatattttgagtagcaagggtatttgcagcttaaaatgtagttgaaccaacaccaacataattctgacccaacaataacgacccagcccagtgtcaaatcagttatctgacaacagtgtcacactacagacatgtactgacctaagtcctgtactgacctaagtcctctaagtctttttaggaagagcaaaaaagtcaatactacttcatcttctatttatggagatatgtttttgtatacacgtatctctttgcagctacactagtttggaggctagtgacgtcgggaggggcctgtgatacctacctgttcctctaccgggccagtccatagagaaggtatacctagcatgcatccaacaatgcacctgagcttctttagctgtacaagggcccattgctatattaaagaaatcctccagggagctaaggctctaagacacatctttacaatgtttcattcattccttcaacaaatagtgcgtgagcattcgtacctggtggtcattgctttaggtactgagacaaagtgcttcctctcatggaatttatattctgctggggtcagatgtgctccaaaaatacatgaataaataaacaagaagaatttcatatggtggtgttatgctgaaaataatagcaagaggtgagggtggcagggtggctcctatggactgggcagtcagaatgatgtcatttaagctcagacctgcattattagcaggaagacgccatgtatagataataagaaaaaaaagggtcacaggcaggaaaatagatggtactagaatttgaagcaggaaagagcttaatatgctcacagactgggaaggtcagtaaactgcctggagcataatgaatgggggttgggatagaacacactgacattgaaaaggtagaaaggggttagatcctgctgacctacataagtcagggtcaggagtatagattttattctaagtgtgatatgtagccttagtgatcattgaggtttttggattttagaggtagactctgtaaggctccagatagaattactgggtagctactttttctgtttgtttttggcatcagcagtcagttggctgttggggtcacttacttggttggggaaagttgttgtatgggtgatgtttgaggagagaacacaagagtttcattggatcatggtaagtttcagatggctgccagtcatccacatgttggtggcaagctgactgttggaaataagagtcctgaagactcaatgtgctgtcgggcaagagcaaaagacctggcatattcagcagatggttcttaaggcatatccatagggaatgtcatactaacagattgatcagaggaggaaagaccagcaaaggaatttgagaagtggccagttaagtcagaggaagactgaagatatggagtcttgtgaactcaaagaagtgtttcaaggaggcagggcctgactatatgtgatgctactgtaaggtcatggtagacaagaacaagggaaaaccctctagatttggcaatacatagatcagtggtgaccttgatgatagtggccctagtggagtggtggggaggaaagtctgatcagataggttaagaatgtcagaaaggacgtaaaaataatgattgtagataataagctcaagattttatgtgaacggagtgaagagagtggtagttggaaggaaataagagatcaattttttaataggagaaccaagagcgtatttgtataataatggaaatggactagttgaaagggataatgtgatgattcaggaataaaggaagatataattgcagaagcaaagaccttgagaaggtgaaaaggaccgggatccagaccaaagcattaggattgatttctgataggcacagagatatcatcttcatagaaacagtactgaaagagacaggatagagatacagatagtttatttgggcagtgaaaaggtataggagtttctgtctgcctcaattttcttctatatttgagaaaaaaacataacccattctcaagggcaacaggactctcaaaaaaaacagacaagccaacacctagtgggaccccacaaactacaagtgaaaacaaaaacaaaagcaaaactctacatgaaagtgggcaagaaagaggtaagcaacttctgaacagagaaatggggagaggaaatgtgatatcctcaacagcataaaaatgtcttaaaattacggaactacgtcttatcctgtctcagttctcccacaccatttctgacacttaaaatggtgccattgacagccttctccccatatctggtctctcatgctggtatgctgaaactctcactcctcctccaaggaacatctcaaatatatcacccccatcaagcctttcctgatatccatcagtatcacccaccatcgatcttgccctactttgatttctcacagttttattacatgcttagtaaggtctttcttgtactgtattatagctttggtaggctttttggaggaaataatgatatcttcattgtctatgatgccttctaaatatttttcgctactctgacttacagtccagatattagctaatcctttgcccagataaggcttactcttttttggttctaagtcaatgtagttgcaaaattcagaccttcacatattcccccaagaattctagtctcgacaaccctgagaataatgtaagctgatgccaccattccctgctggcaggatttttttgggtacatgttgatggcctccagtaatgagatgcaagtgagagctaagtccccttctcccaacccagccactaggtgagatgctgcaatgaaaacatgtatctgactaatttctgcaacacatacatccttttattcatgagcatgtacacaattttttttctcatatgagatggcgaagcaccatctctgttaagacactttcaaaaggacccttgtatgaaaagattacttgaggcaaatgtgacatcatgtcagcagcagaattcagccagtattccagttaaaatcagccaaacaaattctctgttaagtggcaggtcataagaattattaaatggatccctaagcgagggccaccactagaaaggagcatacagcttttggacttgctagatcctcataccttatttattcaagggcagctgttcctgtgtgatgcttttgaccaatccacatgtcttgaagaccatccatttcaccaataaaaaattataatatttcttatgttaaccaacaaagtctctaggtagagatttaggtaaggagagttgatcacttgtcttggctgccattgaacggttgactactaataagtttctcttcagtgctaccctctggggtgtgtattcttctcaagggcacttcaaatgttagctattcctagggtatagataaaatcaacttaaacatatatagcatagggtttaaatagaaatattcaaaggtaaataatgaacacctaaattaataaatttctccctcccttttttctttccttccattttttttctctttctcttctgttcactttttccttggtcttccatactgaagagtgattgagtcattgtaaaggatattttggagtgcatattgtttccactaaaatttaaaatccacagacattgttgctctccaaagtccctccttagccaccctgacaccagcagctctgctttcctgaatcctgtcccctccacttgtggaatttcaaattactttcccatgtattctaactccctataacactctctcagcttttaacttgccaacctaaacaccaagattctcaggaaaacagagactcctccagagaattctggccggcctccttagaaggctgtttgtggaacatctttgtttactcaaacatgtccttgaggtctctaccttttctcatctccttagtaaacaactttgctgagcgattatttcaagcaaatgcaatgttgttaaaataaactaaaatggagaccaggcatgaaaaattctagagaagacagagataggccttgaaagtgaccttaaacttgtttgaatcgcaaccacaagtggaacttaacttgagctatttcttataaatgccaacattaagaaacatggaactttaactgaaccaatcaaaagctgccatctaacacagagttatgtaactagaagctttccagtaggacagacaaaacgaggcaactacataacccaaaccaatcagatatcttccttgccttgcttctgtgttcactataaaagcctccctcttgggcttcttcagtggaaccctgaaccacttgctgcctgattcatgagtcactgtttgcccgaataaactctatacaattttattgtgcctcagtttatcttttaacagtattcttctcaagaatgtaaataaaattttcctcaacctcattactaagaatgatgtttcattcttagtgtttaaaccttacaaaaggtccaaaattcatgtcatcccacatatattcttatgtacccttcaccctctacggaagtcacttactgttgacatgcatatacatcctcaagggctttcatgtattagattttttttttcctgctatgtgcacgcacttctcacttctttttgttgtccttgggtttacacttttagaattgtctcagcctaaggtaatcatgagaataacctggagattttgaaactacaaagaacgtcactagatcttttgaatcagagtctgagggttatacccagcacctgtgttttgtaaaaccatcttccctggtaatttttgtacacagccctaagtaagacttctccactatttagcgcaggaggatagcgttattgttttctttctttgggaaccacctgtggttagataattaaggcttttcagtgaccacaagctctggcacttgctccaggatcaactccctgccagtcactctcccagtcgtccacagcacaatccacagtgacttctaaggccagagaggcaagtttgcacttgttcacacatcatttttataccattgcttgtcacctgaatctcattcttgctcccccacagggagctggtcaatcttgctgaagagtgagtctgggtaagctccctcctaatcagagcaactcagtagtctgtgcctgtgcccgagactgctgacccttaaattagggaaactcaacatttgctagcttccctactggattaggtggccatgactgtttgatgctgcagctaggatgaactagggtgattttggcattgacgtttgtctttagtcacaaagctgggaactactgttggtgattcatatacacaaaatgaagggtgcagttcatcgcatttcttcttccaaggctctcatttgtttcaagttcatagcccaagtttctccttaccgcaagaggcagtccccccagcacttgggtggttaggtggatgacatgacttcacactggcatgggcgctgcctcacaccttagatgtttccacatgggcagactgatatagtgaagcaagctcgggctttggagccagactgatctaggttcaaaccccagctctgcagaacctaaagttctgtggccttgggccaatgaccatactttactgagattccatttgcgatccataaaatgaggataattaaaaaattaataatacctgcctcacaagtctaatggacttaagataatataaggacatctgttaggcaatcagcacctgctccttcctcctttggctcccatacaaaggagggtggggtccctcatcacacctcctgccttttttttttttttcttctctgagacagtgtctggttctggctctgtcacctaggctgaagtgcagtggcacaatctctgctcactgcaaccttggcctcccgggttcaagccaaccctcctacctcagcctcccgagtagctagctgggactacaggtatgcgtcaccatgcccagctaattcttgcatttatttgtggagactggctttcgtcatgttgcccaggctggtcttgaattcctgagctcaagcaacccgcctgcctcagcttcccaaaatgctggcattataggtttgagccactgtgcctggccctcctgccttgttcttagctgtctttctcaaacgagggcacaaacaacaataactactgggagaactttgtcaaagcatccattctcccacccctagatccaaccctctttgaaatctccaaccttacctccttctcctcctctcttggtgccttcctggaatgtttcccaggtgctggactccacggcacaacaagtgaagcactgagggtactgacttaaagaggcattcaccctctcccaagtcctaagcactgactccttgaattgtgggccctgggtgcctctcgctagtcttggccctgctagggctttccgtcgattcatcatttgctgcacggatgacaaccatttcttttctcccagtaggttagataaagcttagattaattaacagtagagcttaggcaacttttcttgctggagtacttacaaaaaaataaggggttcctgagagccacccagactgatgaaagatcagcctagctgcactttagactcacctgaagtctagacgctcagcttccagggattctggttccattaggctggggtagggcaacatgggtaattttaaaaagcttctcaggtgatttgtaagatgattagggtccaatcactggcccgggctcagggaatctgtattcaagctcccagatgattcctacatgcattaaagcttcaaaacccactggcttcctattaaactctccagctctgaaatcagacccaggttcaaatcctcatgtttttttgttttttttttttgaaatggagtcttggctctgtcgcccaggctggagtgcagtggcacaatctcggctcagtgcaagctccgcctcccgggttcacacaattgtcctgcctcagcttcccgaatagctgggactacaggcgcctgccaccacacccggctaattttttgtattttttagtagagagggggtttcaccgtgttagccaggatggtctcaatctcctgacctcgtgatctgcccgccctggcctcccaaagtgcgtgagccaccacacctggcctcaaatccttattcttgcactcactaccatattactttgagcaaggttcttacccgcttcttcacctacaaaatgacaataataacagtaccttccacagaagtgttcatggggattaagtaagatggaaataagttagcatactgtatgacatacagcaagtcccactaagtgataccttattaacatgctaaagcatttattgagcccttccttattgtggattagcattttatgtgtgtgtgtatatgagacatagtgactcatctccaggcctgtgactttgggctacttaacacctttgtgcatcaggagattataaacagcataaaagaagtaagtcatgaggattcaatgaaatattgcatgaaaagtgtttagtagagccctagtacatagtaaatgctcagtaaatgccagctgttataattgcacataatagtcaattttcaataaaagttgataattctggagtattcttaatacatttcctgtccaagaaaatacccagcttggctcctaagtaaagccaaagatctttcttgtgcttatttcttagattttgctataggggctggcccgcatcacgggtttaaggaaagttttctaaatgcacaaacgaatggattactagggaatttccacttgccttcaccctccacactgattttgcctgtgactcaagatcgtgaaagtcttcctgaccacggggccattcattccgtttccaaatgctgcaacccgcccatggctctaatcaagagcagaactgatttatgctggaagtggagtgagccagggaggtggaatcctccaccgctgatttgtttattgctgagtccttgaaaattgaatagggaggaaaagggaggtgtgagaaatgagttaagagctactccccatcacatttgataagaggttctttcactctggaagagtatagcttttcgttgttgttaatatgaaaatgctataagtgctacaaaaacacatgtcaagttccatgcctgtcttccacctgatggccaccaagagccctgacaatgatggaatagcaagctgcctggatttctagggcttaattaaggaactgtaacaggctatgctacaactctgtaatactccttggtaaatgactacagtagataaagaaaaattggtttcctccatttagcagatattgattacagggtttgttttaaaacatttagactaacttggttctttgttttatttattcacttccatgcattaattgaaagcccacggctcagattgtattaacttgatcgccctctactggccacatgctggagtacatgcctgtttttgacctatcctacaaaaactacagctatttttagaaagtattggccttttcaagtcaaacatactttttcaaggtcaattatgagtacggtggggagactcctgtatataaaaccccaaattgtctactctgtttttgaatattctgcttcctgaaagatctttcgattccatatatttgataatttaagaagaaccatgaccaggagccagaagatctgagttcacatgggcctaccctctcatctatgaaaggagaaggttgaggtaggacaggcacaaggcccctttttaatctctcaagctggggcggtagggactgcaccccatgttagaagccaggtgccctgcgatcgagtcctaatttgagatttagttctgattcccttttactcttgctataaagtgaataaggagggtatgaaatctccagggttcctttgaattccaatatgttaggactcaattcatactaacctcgagcacatataagtgacagggaggaattttcggaaagataattcctcttaaaacccctttaaaaggttattttttcttttttcctatgacaattttctagaaaacataggatttattcctcacaaagctccccatacttgtagctgaaactattgtctccacatgaacagtttgaataaactgtaacatttttattatctagaacataggagagaaaaaaatccaacaccagattctagatggagatttattgcagattcttataatttgggggggaaaataaaatgatgaggcccttcaagtccaagggagaaaagctggctctgagtccctaagcagaaacattttttaaaagctgctctacttccctccacaaagcagatctgcaatgtgatcggcaaccttttgcttccatcattttggtggattacccagtccctagacacagttcaaagaagacatttgctcaggtagggtgagcacagtgtaatcctccatccttgcaacaaacattaagagcatttaagaaagtcagagcaaggcaatgctggaagaacttcttttctactatgagaaaaagcagaaaatgccacatacaacaatgtaaaattgattgacttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttttatatatatatatatatatatatatatatataatatgtatatgatggaatactacccagccataaaaggaatgaattaacagcacttgcaataacctggatgagactggagactattactctaagtgaagtaactcaggaatcaaaaaccaaacattgtatgtcctcactgatatgtgggaaataagctgtgaggatgcaaagacataagaatgatgccatgggccaggcgcagtggctcacgcctgtaatcccagcacttcggaaggccaaggcaggcgaatcacgaggtcaggagttcgagaccagcctgaccaacatgctgaaaccccgtctctactaaaaatacaaaaaaaattagctgggcgtggtggtgtgtgcctgtaatcccagttacttaggatgctgaggcaggagaatcgcttgaacctgggaggtggaggttgcagtgagcaaagattgagccattgcactccagcctgggtgacagggggagactccgtctcaaaaaaaaaaaaaaaaaaaaaaaaaaaaagaatgatgcaatgagatttgaggacttcgggggaagagtgggagggcgcaagggataaaagataacaaatatggtgcagtgtatactgctcagtgatgggttcaccaaaatctcacaaatcaccactaaagaacttacccatgtaatcaaacaccaactgtaccccaacaagttatggagaaataaaataaaatactgaagtacaaactttttttaaaaaaaagtgaaaaacacaggatctgtatattaaattacaaattgctgatgaaagaaatcaaagagacctcaataaatggagacatccctactaggttcatggattggaggactcaacataataaagccatcaattctccccaaattaatctgtaagtttattacaacagcaacaaaaccaatactaggaagggagtcataggggcattacactcatgttgtagatgataattaagaagattatgtatcttccctacaaagaccaaatcccacagataatagtactattttctgatatttaaaattttgctctaagagattttcggagaaaacattcaagtccttctaaggatgctagggctgtatggatgcatacatgtgtatcttcttttccgaagggacaaaaaacaaaataaaccacatatttccaggggaaaaccaaagcaatagagtagagagaagaaatgtttgagtttgattctgcactaacttttccaaagcaagagttctattcagtgtgagtaccttccagaacaaggcactgtgtgggaaacatcgtagaaggctgtaatctttccccagatcatttcctggttggggaataaactattgcagattaatgcagattacattgtgttctctctgaggactgtagacaaaatagtggctattagtttctagggactggaaattaatagagagggagtttaatgcaagtcacattcaatcccatgagcaagtctttaaaatctatcaggtctagttcaaaaataggtctcacattccattattctctccatctccactattactatcttagatcagtggtccaaaagataggaacaggagcattgacagtgtgtttcatgactttcaggcagtcaatttcagagaaggcaatagcaaagaagaatcatgttcctttctgacttaaagaatttgagaccctgttcctattatctctggaatctagaggcatcacatcccatgcatcctctggcatcatgatcacagaagttttatctgcaacaggtgtatgaggagcttatataactgtgcatgctcataccctcctaatctcatccgcatgactattctgcaaacacaaagcataaaataccccagactagacaccggcatgagtccagctgaaaaaattgacagatcagcatggtctctgtataagcatgtgataaaatctctacagtcatgttttccaactgaatgctagctctccctcccctggatccccataacctttcttccattctctgataatagcttttcatttgctttctctgcctgttaaactgtaagttcctgtgggtagggagcaggtatgatcacgtgccttacttaactcagacagcaggataaaatgagtcctctggagtctcacagacctatcctggaaggccaactttactaactgtagggctttgggcccttaacctctctgagcctcaattccaataggaaaacagttattgtaagtatccaatgacatttatgcaaatggcttagccaatgcttgcccctagcaattgatgtgataaataataccactgtatcctaggttgggctctctagagttaatatttgagatggagatttgggtgtctgcgatttacctgaaggagaggtctcagaaagaaaggagttagggaagtaagacagagtcgggggaggagctaagctgaactctagcttcagcctgatcccacagggaggtctgaagcataaattgcaccaaaaggttggttccctcttgggatgggtccagccatttctatcctccccccattcaaaccctccatatccattggttactggctataggctgccttcctttgtgggcacagaaggacgtatcctccatggccaagcagctcccatggccaaggacagttccacgaagaatagggcagttgtgagctgacagtaacctatactcacagcaaccatgtaagggagatctgggaaaggcaccagaaacacccactacactattattatatttgtatcattctatgtccaaatatgagcttttgacatgacagggactcaataaatagttgaactaaattgaagaatctaaattgcatagactgtgcaaagccagcatgaatagcttttgtctcatccgcatattcaaaatctttggagacagctgtcacattcctccccttcactggccctcagaattgccaagactacacaaggttgtagcacacccctaaattcccaggcacactgattatgtatgacgctcacttaactgtaaattttcttgcttctcttgtttcagagattttctggtgctaattacacctacgcttacatccaaatatttcattgtgatgcagattatacttgtaagtgcatgaattattctttgaaggcaaaaggaattaataatgtttcaccattcactgtgacatgtttccaagcatgtaagtgacaggtgcacttttaaataatgtactttttcttctccttgacaagcaagaacccagatttaaagagatagaagatgtgaaggattgtcttgtggatctactgatgtcatgcttgggtttccatctccatcagcaaatgaacgaataagtaatgtatacaggtcccagtacctgctcagattagattgtatcagcagccttacactctgaaataccattaggacaaatccccaggcactcagggatagaaagagagagctgggttggtcatcagtaggaatggaggaaagctttttgtaaatcacaaggtgatttataaaggtcaattattagtattaattattctactatcaactttatgttcagtgctcctggctctacctacatctccttctgaattaatcagccccttccagagatttcacatctgttcaggtgactagggacaaataaaaaggagcctaaacaggttgaggaacctgctcttttcttgtacttttatctaatactctctctactggtagagactaaattgaattcagaaaacaaatctagcaggtggttctagagccttaattgtgagtggccaatagataacatataaaaggaaatggggattttatacatcatcatcaccctcatgaagtcaaggaaatgaatgcctaaagactagttgttgaatttcagaagattcatgtgtgtaaaacaagtggacctactgccccaattcaccagatttcattttagttctattaggatcatgaggtatttgagaaaagaagaaaaagaaaaaaaaaaaactcacaatttggtatgggcaatacaaaaagttctctctcacatgtattaatacatccactttaatggcaaaaacagactttaattttggaaaggaatatagctgagctctagattagaagcccataaactatggaccaaatctctcttctgcctgtctctgttagtaaagtttcattacaacacagccatgcccattcatttacatattgcctatgcttcttttaggataacaacagtggagctgaataggtgggaaaaagaccacgctggccacaatgccaaaaaatagttatatttggccctttatagaaaatgtttgctgactcttgctctacagccaaactccttgatattaaatactggttctatcacttattagctgtggtactttcagaaagtttctcaatgtaatcatcgtgaagaaatgaacactatctaccacttagggttgataggaagattgagtaagtttaaatatccaaagtgcctagaccagcatctagcatatattcaggattcaataactattagccattattattataaacagcaagaacaaatatccttctccccatacgcattgttggctctcatgccaaaagaaccacccagaggcccttctgccctttctcatggataagtttggaatgtctctccaatgttctgaatgcacatagatactttctaggtattctagttattctatagcagctgcgcagaagggaagccatttcttttcttttcctctctttattcttggaagatggcttcagttaaaaagctcaagcagagatttcaaacctccttcttctgtctaaaatatttaatggccagcctaacaaccctggcaaaacaactggtttgttttcacaactcacagtgttttttcatctttagaatcaattagaggttctaaagatattgtaggatcaaagattggcttagaatataaaccttgaattcctaagagagcttacaagtttgtccagattagatgctcaagatgaacagagggcccagcctctgtaaggtaggaatgtaaagtggggataaaattagtagaattttgaaaaacccacctttttgagaaatacagatgaataaatagattacacttctttctctctctctttcacttcctttccaccttttccttacggccaggttaataataaaaaggtcagtgttctgagttctaaaaaaaaatgtatactgatacccatatgcataaggcattgccctgggcaccatggagaaattcaatgtggtaaaattcccatcctagggagttaataatctgcttgagaaagcaagacaagcccatgaaaagttaaatagcaattaatgagttcaatgacagtacaagacaacagtggaaaagatactgctatgcaataagtaattagttgctaaattcagatagttaatattatagaaatttcaggggaaaataaaatccacatgatgtaaatttgttaaccaaaacacaagaaaatggccatcctacttcctcttactgaaggaagataaaaacactaaagttaaatatgtatttacatttcaagtgagtaatttgaggtgttttcatttaaaataaacattaattaactagcttcccaggctaacaatgtgtgttaatcagtcgctgaaccttgttttctaacaacttcagctgtaatgtgtaggttagaccaaaagattcagatggaaatcagaacaccaggaatggtgaagtcttagaagaaggcatgctcctgtagcaaaaacaggaggatgggatggggtcctgaacagcatcaaaaggcccacaagttgacagaacatagctgaatatcagagtagcctccccagagtcagtacgaatgaacaggcatggctgaattctaaaacattctagaaagattaagctaaaacatctacaagtgagtctcctgaatgaagcttctttatcatattcaccaattcactgcatccacccttatttcctagatgtttggggaagaggcttatatccagatatgccaccaaattcaaatttaactacaccctcagatttctgctccttttggaccactagagttcttattttggagcttgatgatctgcttgtataaactccgtaagcatagcagtaaagaatgtgactcccaaactaaactacctaggttccaatcccaatcccactgctgtgatctggagcaaattgcttatccatccactgagcctcagtttgcccagttgtaaatgggaaggatactagtattaaactcatacagttgtcattagggccaaatgtgctaatacatgtgaagctttttgaactatacatagtaaattccttataaatataagctggcataccctgtcactgctaagtaagagggcagaattagtaattcttttaattacttaacatgccagctatagaggcaacctgcctccttctctgggaccaacactggtcctacaaatggagctataacaagttggagtttatcaatttggtagtcttctttctggccttgtgtgtatcttaccccactccttccactaatacgacctaattataatattataattaattcaaaaattgtccttcttcctatcaggtcctggctccagactacctgtgtttctctggaaagagctattagtgttgaccaatgtcagtgattctaaaaactaagtcattgcatcccagccattctccatccactggggccccctaatgctatgctctgccactgatatatgcaggaggcagataaggaagggtccccagagaatttctgacctgccccacaagtgtttacaccagatgtttttgtgcagataagggaacctgcacagggtctttcctgggcatgcccacatgcactgaaggaatggagtggagccaccaggaattcacaccttatgcaggggaggagcctggcctcttcagctcctgtgtggtggcctggtattcaatctgcgaggtgggagcctattggcagggccccttctttctttgctgagagatttattttcgcctaatacaaccactttcctcacccttcaatgtgtctgtgtgcctaatttttcctggtcttgagacaagacctagattttagccaagctaaggagcaaaaaatcctgcatcattttggtggcccatatggggacctgaggaagggtgagtaaaatacggacctgaatgtttctttcccttttgttttggagccttcttgttctcagatttcttctaaaggtagaaaaaactgagacttgccttgtcactcttgggggtcaggaatgttggcctcagtccagcccagttttttctatggcaatttccttctttttattaggactgtaatggcagctatcttttcttttacatattggggggtgttccacccccaccccaatggccacaggtgcatgcacaggacagatgggtgagcagcagctccccgcccccctcccctctcggttggggctggggcacatggcccaagggccctgcgtggctggctggccagcattccctgccatgcaccgggagtcttcccctctcctggccaaggggtccacctcagtccaacagcaattaaaagtttctctcagctgggcacagtggctcacgcctgtaattccagcactttgggaggccgaggcaggcagatcacaaggtcaagagatcgagaccatcctggccaacatgatgaaactctgtctctactaaaaatacaaaaattatctgggtgtggtggtgcatgcctgtagtctcagctgcttgggaggctgagtcaggagaatcacttgaacctgggaggcggagattgcagtgagctgagattgggccactgcactccagcctggcaactcagcgagactctgtctcaaaaaaaaaaaaaaagtttctctccctgttggagaaacccatttacataagaataagaggttattcccccaggcatctttccagtcctgcacttaaactattattattttcttcttttttcaccctatcaggagttaacttttgtgtgagagatttttccttttagaaggtgtttttactaggccaggaccccaattcacaagatgctcttttctctcccttgttggaggggaacttggttccacagctttgccttaacattcagcttataaggagtccatgaaaccccatgagacacatttttgccccaaactccattccaagctttggaacttgaaggctactgacagcaggcgggacatggagttcatgggtaagagcagataatccctccctcaggcccccctattaacatgggtgaaagccacattgacactcatgggcagcaccctgtcatggccactgggattcgggaataaaaagatggaagaaggaaaaaggatgctttttccttctctcactcatatagcctgggtattcactaaaaagagaaagggaccaggggtgcctgttaccccttctagatgagtagccattcatctttagtctagttggcttggagttgagctcaggggaaaggaacccagaagcctgacatgctggcaaaagggtaaaagtttttaccagttgggcttttggcttccctctccctgtgcacaccagtaagaggaatgataagaatcactgtttatattatctgtgaagttctgattaatgaaaaaggatatatgaggttggtcttaagctgtagccaatctggtatgctttgcgtgtcttaattgaggtttgttggtcccactggtgaggttacttttgataaagttcaaaagctagatacatcagctgcttggcatggctaaagtgaactaataagggatttaaaaggattttcttaaagagagctcagcttaattagaagtgtatatccaagttataggtatatttaaaaggcctttatgtttttctcttcttgaatcttattttgctgaaaaaagggttttcctcagttgactgaattatttttctccattttgccttgccactcttaatgcatgcattagagcccctaagataatttctgatggcctgggactccttgggaaagacagaaaagacaccacggattccattttgggagaaacctctgttttcctcatggaagcccaggaattagaagcggataaatccctctcaaaatctgtttttgtcttccagctatacctgtttattgggccctggaaacagcatgctcttaaagggctccatcctgaggcaaataatccaattgggattgttgagattgggattttttttcttttttctccaccctgagaattgagattgacaaatgaaaaattttatagctactggatcttcttctgtctgtgtagttatatatgtgttgtgtgtgatgtctataaaaaagagctctaattaattggcttaaagaaaaataagcacttagatcaaacttagtcaaactttattgatgcctagcacataattaaaacaacttaccagattttacattacagttaaaaattcctaagagttaccactataacatgtaattgagaccactgaaaatggatttacatacaaggtgtgtaagaacagtaaaatgtgtttttagtaaaagattataagagggcatggaaatgtaaatttttgcctagggctaaagaattttttaaaattagataagataaagctaaaggtttaaacacattgtggaaggtttctaagaattaatcttgtaaaagaaattctgtgtttgcacattgacaaaattcaaaggggtattatatggttttaattcaaaagggtattatatggtttttctgcaaatggaacattgaagtaaaagcacaacaaggttttcttaaggcactaatctgctctttagcaaaatttgtagagggttataaaaggattataaggatctcacctggtggttaaactggttaagataagatagaattgtctgtaaagtttcattagaaaattgggatagacgttaatagtaagggtaaaattactattaatgtaagggtaaaatttggctttctctcccttgtacaagattttcacgtactagtaaaggataatgagcgattttcatttgccttgtggatagactgccaaggaaaagaaagagcagacaagagaaaaattttttggaaaacaaagtcttccctgttaatgagtaaagattttctgccttgttttaaaattcctaagtcatcgttttggcaaaataaataacttatggtaatctgaaattctattttatagcatcaagtgttttaaatttttaacatatttaacaggcttccctgaatcaaatttcagcttcaggttgtcttttctgacctcagcttttggatgctacagatggcccctggagcacccaaaagagaggtaaacaggattatttgacatgttgaggtacatgggattgccaaaatgatgtttaatcttcttcaggttataatttagggaataatattaatatatattccaaaattgtatgggatttctaaaattctaatgtttgggtatatgctatcaatcatgattaaggttgatattatgttaagttattgtaaaccacagagataaccaaatttctttgtcaatcgtgtttttgactgtaactaccctagaattttttttattcacaggcaattgttgtcttgttttgatcctgttcaaaagatggtttataatcagctatagaactttgacaggtactctcaaatgcagatttcttgtaattttggagattgtgacattggaataatgaattcatgaagagctgaaatgttcatgaatatcaaatagaacaagagttaatggaatggactgaactaatagaaaactgaagtagcctttttaaatgtttgcttagaacactgctgatccttgttttgtttttcagagtcaaggaaccttatgttcagctatttatggcctttaataattgaataaagtacaattctgtgacaaaatttggagcatatttgtttctctttgcctggtttctccagaatttggaaactagtcatgagtattcatgacttatggcagtattcatgacttatggcaaagtagttatttgtgtcagtgcaataagaatccattttcttttgcaacagaatgcaagtggagaaactggttgttttaccaaagctttgactggaagggtatgcatcccgttaaggaatcaagcttgacttgcagagctgataaaagtcccttgggaaaactggcctcacaccttgtattcacagtccctgtacagggttcctgacccatggtaagtaaagaatgttgctttctaacaagtccaggaatcacatgttcttggacctcaagaagagaggagtttatgcaactcaggtatttgagggtacaaactcatggctgggctcagctttaaaaaaaagaagaaaaagtcttatctcagattccttgtggaacagagttccatcaaagccaatctgaaaggcctatgtaaaaataattatttgtgctgtactttatgcaaataatcaggccaagtataagactaaagtctatttttcaaacaactcagtcccatcatgatttctttttgacaagaatgaggactggagagagataaattatgttccaaaacttagacatttgtcattaaattctagactcattagctgttttaattttttttcccccacattataagttaactctgattattcctgtgaaccaaccagtgatctccaactgcagctcagaagaaacaaaagagatgagtaatgtaaaaatctggatcaaatagtctagttctgggcaattaccttgcaaatcctggcaggtgataggagtaaatagggtgcccatcacccagaggtatcctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacatgttttccaataacccagtttgtctcttctggccttcaggccatcaaactccaaatactccaaatagtcctgccaccggagcctttgatgatcaccccttttaccagggacccttatataggcctatgagggagatctgattgctgattccccaaaacagcacccctgtcagcaggaagcagttaatattggtcttcatccttaaccttatccttatccttatccttatccttatccttatccttatccttatccttatccttatccttatctttaacctaagggcatttagatgtacttctaacctaagggcatttagatgtacttctttagtagggggaatgatagatgcaggaggcagataaggaagtgtccctggagaatctctgacctgccccacaagtgtttatgccagatgtctttgtgcagctgggggaacctgcacagggtcttgcctgggcatgcccacaagggactggtggcccatgtgcactgggtcaatggggtggagccaccaggaattcacgcctcatgcagggggagaaggctagcctcttcagctcatgtgtggtagcctggtattcgatctgtgaggtgggatcctgttggcaggacccactctttctttgctgagagcattcttttcacctgataaatctacctttctcacccttcaatgtgtctgcatatctaagttttccttgttgtgagacaaggacctggattttagctgaactaaggaggaaagaatcctgtatcattaccttctgagaacttgtttatggtaggactgctcaaatgatgactacatattaacctggataccttccactgttctgttgaaatcttcacccatcacttccctgcctccaagaatctgactggtttccatgtctttgccatatgtggtttggtgtctaatctacttaaatgctgtcagagttttccatatagcagatagcctcaaaaggctgaatcacctcctctcttgcagacgttatggcaaatacgctaagaaatccttccaagcactctcaaaggattcaccttctctgcctcatctctggttagttggtttgacaaaatgagaagacgagggtgacattcagaactccttgattctgctattattggcaaaactgtctcattagcattaaaatagggagaagacctaggttggaagggatattgcttaaaaaagaaaaaaaaagacttctgcttagcatgcaaactaaagcctaatacttagtatgtgctgcagaacagagttgctgaatagttctgccataaatcattctacaatgcttaggtatgtgaagctgtaaacccattccataattttcattagaaagagaccttcatttcaaaaaaaaagaattgcagcccctcagtagagatcctctggaaatcacataaaatggaaaaaaatgagggaatctctatctatctctaaacacacacacacacagatacacacacacacacacacacacaccagggcaaaatattaacttccaatcactgctagaaggcactaggtcaatcacagctcagaacacagtgaaaattgtgttacaaaagcaagcccgtctcccagacaatcctgcccctgctgcacacctgtgctgccttctcatccaatggcctccagaaacctgtaggcaagaagctgatcattaggagccttgacctactcactcgtccccaacctctggtgcatctctcagaatgtagcaattattatcctagcaccaacagcagcaaactaacatctcacccacaaatatacttcttactgcctttcatcgtgtagcaaatatccttttatgcacacctcaatcagaattacccaaacagccattaacacagcttggagagggagaagagtaagaaaaagttctaaaaccagacaaatcaactgcaaagtcaaatttgtattaagaacccacagatgctgggggctagttgatggaagttaggcaggtaaggcaaaatttaaggtgcattaaaaagctcagtgactgagatagataaattatattctaatgcaatacattttttaaaatagaagttaatacagataaattcattgtgaaccaaatatcaaaattttaaataataaaattcagcagtaccataatgagccattttaaagcctaagacaaaagagaaaatcagtgatgctgatcgtgttttcattaaatatttggatatttcattcatcatggattttttttgcatgaagtttgattttttaaaaatgttttattaaaatattacatatcttgatttaggagtttcctggtggcaccctcttaaatttgcacccaaggcaagctccttgcttatcccatgcttatccctgccctgctccaaattactgataattcttgtatcactagaaagaacaagtattgtcttctgatatagccttccataatattgctacccatcttatcttaaaaaatcagaggccccggaattagtacaagtggaatggagggcagatcctacttaagcattcttaaacagcttaaatacgcctcttgggttcaactgctatggcttttattcaagagaaactgtaattggaaagtcacaaatttaacattaacttttccatttctgctgtatgttgggtttagtttcacaaacaaggtccttttagatcagtaattcccaggctttataccatcaaagactctttttctccccacctgtaaccagggcttgtgttttgaaatactttttttttgccaaacatttatgaatgaatttatgcataaattctgtccaccatttaataggccaagatatctgaatttgccaatcatatattctgatcagtgggagatcacctatgattgccagagggaaccagcacaattgtgatcaaaggcggagatacttgacctgcaactcagcctgccaagcttcatcaaggatgccacaatttcattagatattttgaaatactgagttctcaaaaataattataatgaaatattaacttaaaagagtgacatgaaagaaatggtaggtataccatgttttcacctagctttataaaactgtaatgtaaaaaagtttggtatagtagtaacaggattacatatatatgtgtgtgtgtgtgtgtgtgtgtgtatgtgtgtatatatatggggtgtgtgtgtgtgtgtgtgtgtgtgacgttttcatttaaaagttgaaaaataatccagatctccattaccagctttctagttctttggggacctaaggacctcctatgtaggaaccattgttttgttgaaacaaatcagctatggcaaacaactgaaagagatctggtagagcaatgagtttctgagcaagtatgaatgaatacaaggcttataaatgtatggaaggaaagcagaccaagggacccaaagccattgatcgaagcctgacataattcattaagaaaataacatttccagaagtttttcaagattatctactagaatgtaagctctctgagttgcaggaaccacctgtgtggcctaatatcctgcagcgttctccctggacagactcaatgcatatttattgaataaataaatgaatgaggagttccttcttttatcaccattgttttaacatccgaataaactttaaaaggcatcaggattagaaaaccatattaagatagatatgggcatccaataggagcagacccttgggaccctgtttaaaaaaagcatcttgtcaagaacaatcattaagagacattataaagcacctcattcattcacacctgttggctaacaaatcaatgacatgttccacagatgcttcctcttggatttgtcccacttgaactctccaatatcttgttcaagatagtatacaaccttaaccacactcatttattcttcattttcactatggtgctccatcctgtatttcctgcctctccaacacactagtttaccctctctagtcctgcatttatcctctctccttcatcccatttcccacctacagaatttggtccagcatgggtaatttcttgcacactttttgagtgattcctcataacaattctatgaagaaggcaatgcaaaacttattattggtcccattctatggatggagaaattgaaggttagagatttaagagtgatgacctcagatttcagtaagtgatagatctgggattcagaaccaggtctcctttccccaggattctgttacattaccaaggacctcaacatggtatacagcatgcagttgctcaaagcctgacaaaatgaatgatataagtcatgtaagaaggttcagatgatactagagagctctatcttcctgtgcctatggaataaaaatataattctttagcatgatatataagatattcataatttggcttgtctgactttcctgcttttttctccatgactgctcattattcccacagtacccaaaccatgctaacctggcaggatcccttgtcctccaccttcatgcctctaagcctttgcctatgctgtttcatcctcaatgcctctcccaccttgttcacctagcaagttccaactcatccttctagaacctgttaagtatgacttaggaatctttctcactgaatgaggcttgctctcctctgtgcccacaacactgttacttcagcagcttccacagctctcaggataaggtccatatctttctacatggcagtcaaggcccttcatgatctagatcttgcttacatcttcagtgttttcttctcctatacctaccatgccctctgatgctattatctctccataatgaaatacttatggttttcacatacacatcactgtctgtctctcctcacagcttttgcacacacagctccctctgcctccctcatcacttttgctaggaaaatttcaacttggtgtttgtgaggtcttagctgacgtgtcacattcttctggaagcccgctgagtcagcgttggtgtcagtcttccttgctgcctgagtgcttccgccatcgtggtacctccttgctagtgtctcattgataagtacttagtgactgacttttccagtgctactgtagtgtgaaggatcccccatcaggttacttaagggtgtatatccactgcctgcatcttgacagccggctggttggtgagctgaggtcacggtgaccagccaaagagcaggtgtccctgagaacccaaacatcccagagtatctaagaacctatcaaggaaaacagtcccatcatgcatgcacagtaggcctaagagccagagaattagcttaaaagcagcttagaggtgggaagtggggcggatctctagaggtgccttcctgcctgccatccaggagtaccctatatgtaaatcttaactcatctgcttgccaagctgcacttgtccaaatcattcttcggtctcttgataccttcctagtttggggatgaaggtgtttttcccataacagttatccttatagttttttttcttctttaatatatttcctgcctttcccagaagagtctgtgatcagtttctcctttattttccttattgtagattcatttccatcttttcaggttccattcttcacagagtgcttccattgtttgggggtgactgatgtttgggggtgactgattgagggtgactgatgctattgtttgagggtgactgatgtggtggaaagaatgctggatggggtgctagctcaggctcaagtcctatccattcactcattcattcattctttcaacagctatttacagaatactttctacctaagtgctaggtactattctaggtgatgaagggaataagcaaagcccctgccctcaaaaggttttccagtaagggagttagaccagattaaaaaaagataatcacatatacaatgtaatatatactagtggtaagtgttatgtgaaaaaacattgctatgatattgctcatcctatcctggacaaacctgttaaagctctctgaaactaaatgttataaaataacattctaaaatggtgctaataatatctgctctaaataactagcaagggtggctatgaggctcacatatgaaagaatagaaatgcatttttgaaaacagatgaagtatatgcctttattgttattattttaattttgatgtaatgcagtgtctatttgccctttccaagagccaacacatgaattttaaaaaaatatccatcagtcatttagatgtttgaaaatgagcaaatgtctggctgacagcctcggtcttcatctgaatgtttggttaacctatctgcatggttggaaaagtcatgcgtttactgctgtgcccttgaaagcatcaatctctaggattattatttttttcttacactattgagataatggtaattttcctgtctaaatataaattttaaatgggcattttcatgcccactttgaaaaacaagctaagcaggactgtccatctcacataaatgttatttatatttctatgtagctcgtttttatttggggcatatgtgaattccaacaatgtgtaggagaatattaaatcattacccatgaaacttaggaatcaaatttaattttgcaactgtttgcaaaatttcaaaaaattgcagcatactttatgtagctttataaaggattaatacataaaaataaactaagcaatgccttttctatattacattttgctaaagaatgttttgatgtcaacttttttgaaagctgactagaagtgaggagagaatgtagcaaatagaggagagcactggcctctttacttatatatttgtatatttatttgcaattatacaataagatgtgaacacatgctcacaataattcagacagtaattaaaaggctcaagttccttttacctattctgttccctcatcataaccttaccccaaccatgaagtgattactgttatcaatttggtatgtatccttctagaatttttagtatgtaatcacaaacatatatatggattttacataaatagcacgctatacatattgtccagcaagtttgtttttgacatatgtcttggagactttaccatgtggggacatcgagttctagcatattctttttcactgtggcatagtattgtattacatggatccactacagtttacctaccccatttctggtgggtgggcttttgggctgtttctgatgtactatgctgtatatggttcccagcacacatgcatgcatatttctccagggtatacactgagaggtataattgtggcttcagaagtattcacttcctttcctccatttaaatttaaatagacactgcagacttgccctccaataatgaagtaacaatgtacacttccaccaacagaatccactccagttaagcatctctgtggtattctagggaggtagtcagttgggcagaagaggctggtgtcctctagctctctgagggttatgaacatacattcagtaggtaaatcccaagaggtgaaaggatctcagctggcaatggttctccccttttcatttcactagagtgaactcctttttaatgcttctttgtcctttcttatttcggtttttagctgaaataagatgtgacatgctcacaataattcagacagtacttaaaaggctagatctttgataacagatatcctgtgaacctgtgtttcacctgaccattaaaatcgttctttggaattaataacaactaccgttgattaactgacacacactttggatgtactatctcaatacatcctcaaaatacatcctcagaataactctgtaagataggtattgctttgatctacatttttcaaatgagtacacaaagaggtatgtaaatctacccagggacataagggctattaagacatagagcagaaatctgaatctgggctgggtggtttccaaccccagttctggggctatgagccactgggctctactgcaagcaatcattcccttctctgctctcctaagcctgtttatctctgcctcccttgcatcaggcattgctttctaccttttattagttatttgtcaataggatttatcttatcttttagcctgttagcttctcaactgaaaaatgcatggatgagtcacctctgtctccaagaccatttcaaaaaatacagtacctcaaacacagtaggaacttgataaatatatcttgaaagaaagatgtacttaccactcagcttcacaaaacttctcccttacaatccaagatcactgactgtccccctgctgaatctgacaatggccttcatgggtcgtccactgtggcatcttttcaggaggtaattctcatatcagaacttctagatacgaatggcttctaatcctatctctaccactgagaaccattttctttatggcccattctcacacgacaccactgatgcaggatctgatgtcttcatgtgagttaatttatctgatacgttaattagaattaatttgccttaattgatcaattggagacattcatatcttgcagcccttcacttctaaaccctgttttctaactttccctcccagacctcttcttctagcatttaaccccagattttagtcttttgggcatgcctttattctgctttccagctcagctgctgagggaaatcctgatttgactgcctggcttccatggcagctaaacatctggatactatcttttgaatcaccttccaattcatgctctaattcccatgggtgaatcacaccctacccatgactaaggcaaatcctcactatttcagttagacccagcatcttgagttcctgtttattcgaatggtaactgaaataacatataacaaacactgtaacaaggactatcagtgttctattgaaagaagtggccctcgtgtaaagaagactaagccaccactttctcctctacctctctgtagcctactcatcctgaaagccatagtccatgttgccttcctcaactgtccccaacagttattaggatacttattaacttctgatattcatcaaccaaactagcatttaattatatatggtcttatattgttttatgtgatctatcatctcccttattaagcaaaaagcttcttgtagcagggaacaaacatattgccatactctcctttatcatcattgtcctcttcaccattgcaaatattttctttaacttattgagtgcagaatgctttacatgaattaattcatttaatcttcacaagaacactatgaggtagatgccattgctatcctcgttatggatatgagaaaactgagcacagagaggataagtaacttgcttaagatcacatggatatactatgtggtgaatcaggtatttgaatcttggcagcctggttctagaatctaagagcttaaccagtgagactttctttcatgtgatccttttatagtaccaaaaacagctgagaacgtacatagtactaaatagtaataaataagtacaaagtaagtactcattagatgcctaatttacagtttgatgcccatgggcttttcagtgtccttgagtcctctctatcatcatctcaagactcaactgcatatagttcaactacttaacataggcctggacacagggaaggggtcagactggaacaagatttgttgacaattctgcacagaaaaggaaacagtcaacagaataaagacaacaccagtagaatggaagaaaatatatgcaaaccagatatttgataaggggttaatatccaaaatatacaagaaactcaatagtaataaaacaactcactttaaaaatagccaaaggacctgaatagacgtttttcaaaagaaagcatataaagagctaacaggtataagaaaaaatgctcaacatcactaatcattagtgaaatgaaataaaaatttaaaccacaatgagatatcaccttattcatgttagaatgtctcttaataaaaagatgaaagataacaagtgttggtgaggatatggagaaaagggatcccttgtgcactgttggtgagaatgcaaattaatacagccattaagaaaaaaagtatggtggttcctcaaaaaatttaaaatagtactaacatatgacccagcaatcccacttctaggtgtatatccagagtatatgggatcagaggttgaagagatatctacattctcatgtttactgcagcactgttcacagtagctaaaacatggaatccatctaaatgtccatcaattgatgaatgaataaagaaatgtggtatacacacaaatagaatactatccagccttaaaatagaaggaaactctgtcatttgcaacaccatgtataaacctagagaacactacattaattgaaataagtcagaaaaagacaaatatcgcattatctcacttatatgtggaacgtaataaagttgaactcatagaagcagagaatagaatggtggttactagcgactagatggtgcagggttggggagatggcggtcaaaggatatacatgtctttttttcttctttctttctttttttttgagatggggtcttgccctgttgcccaggctggagttcagtggcactatcatagttcactaaagcctcagactcttgggctcaagtgatccttccacctcagcctcctgagtagctgtgacaacaggcacacaccaccaaaggatataaatttcagttagacagcaggaatcagttcaagagatctattgtacaccatggtgactatagtgaataactatgtattgtatactcgaaaattgctaaaggagtagattctaagtgttttttaaaaataagaatgtgaggtaatacatatgtataattagcttgatttatctatcccacaatgtatacataaatcaaaacacaatattacatatgataaatatatactatatttatttttattttatttttttttagactataaacataaatattattgtttggcattaccccaaagttcccctttaaaaaaacaaataaatggaaataatatatatttgagtgttctgtctctactttctttgaaccaaggaggcctcatactttatgagtttgttccaccctcttctaatatatctgtcaacagagcatggcaacagtgttacaaaatttaatgttttaaaattttgaacaaattaaaaacatgaaatttatatttctcttacattttactattctctaatgagggaaaatgatttaaattttggactaaatgcaaccagcatataaaataattctcttctgagtgatagtgaaacaattactgaattacaactatatgcagaaagtatttttgcctaacatgttttccatgtgactaacattatagctcattgcaagtggtttatttgttttataattaataaagaagtccaggtggagtttaacacaaaaacagaagatagagagcatttaattttgtagagagctttcagtactaaaataggtagtcagaattttctgactttaatggagtcagaaactgggtaactttcattcttttaacttaaatcagtttctggatttagtttatcaaaatagactatattgtatgtgtattggtgaactagaaatagatcagctctcaagaaaatgtggcacatatacaccatgaaatactatgcagccataaaaaatgatgagttcatgtcctttgtagggatatggatgaaattggaaatcatcattctcagtaaactatagctaggacaaaaaaccaaacactgcatgttctcactcatagatgggaattgaaaaatgagaacacatggacacaggaaggggaacatcacattctggggactgttgtggggtgggggaaagggggagggatagcattaggagatatacctaatgctaaatgatgagttaatgggtacagcacaccagcatagcacatgtatacatagcacatgtatacatgtatacatagggcacattatgtacatgtaccctaaaacttaaagtataataataataaaaaaagaaatactatttttatttttaaattaaaaaaattaaaacagcttgtccccaagagctgtggaagcaatggagaggcagactcagaggaagacgctgcaagagagatggtttgactggagaggcactgagcatgacaacaacaggatatggtccagatgtggcagacagtaaagcacatggggggctaagaaaatggactttgaaagaggactgcctaaactggaatcccagtgccacagagtgctactcatggaactgttgtgagctatgtgagtcaattcttctaaagtactaagcacagtaaaggagaaaggtgtgctgtacctgttaactgctatattattctgaataattagaatgaagaccaatatctgacttctgggtttctgacttatatgtggggcacagcaacagggaatgaaggcacagtgaacatgcagaattcagcatctttcctcaggctctggccatctgagcacacttggttttagtgaagttagcttataggcagttctagaaacaaatttagggaggatttggggccctaagcctagagattccaaggtccttgtataggttaacacaatagaaatgcatgtaccaggtacagaagagagggccctcatcaggactggggtacaaactggggacttggtccagacacaggtgacatctcgtggctcaaccgaggcacaggaccacagtgagacaacagcaagggtaccttggagcagagcctaatatatggggtggaattacagggcttaaatcagtgctacctcttctcaggagtagcgcagaggaccatgggcaggctgagtatgcagataaggattatatgactccaaaggtaaggaaaagctgggagttgggctggacctaatccatgttgcatggagctgcttcactgccctgtctgggcctcaccttcttggtgagcaagcaatctggtaccatgccctttggtgaaatcaggcatggaacaggtgactgaccttggggaacgaaagccaagctgccattcatcacagcccatggtgcaaacctctaaggtaagccttggagcctccagcgccccagcggtggggcatccgtcctctgggcagggagcttcaattcacacagcaggagagccataacatagcaggagacacacagaaggcctttaaatgtctattttttaaagtggttagcaaagcaggagagaaactgtcagagatccgcaatgcagagtttaatctggaaagtcagtgaagaggtggaaggaaacagaaaacaggagactggaagaagaggcttcaggatttggggagagcaaagcaaaaagtgttaacaagaaaaaaaaaacagttgcatatcagaaactgctcaattctcatgtcaacatttacagaacactgttttccatttttccgactgctctatgcatttgacaaatttttacttgttcttaattctagctcaaagttcacctcctttagacaaagccataccctcttctggcctctgttttaatagatacaatgtttgtaatagcatatttcaaaatattgtgtaatgaattgtgactctggatattatagccactcatcattttcttgaggatatttatccttatatccccaggacttagtaaagttcctggcacatattagctaatggtcaattaatggtcacttaatgaatagaagattaatgaatgaagaaggaaccaaggagggaagatgctttatgactgtacagggtgcatgcgaggggaggcaggaagtgagatctataaaggtgtcttagcatatcatgctggtgatgtgagccaagctaagcattgcagctttcatccactggcaaggtagcataataaaaggctgtaaagcagaatgtttcaaagagctgttcccccagtgccatcttcactctatacgttattaatctcatttcttccctacttcgaactaatgtgctcacattcaaagatttggcatatatagacccattcaaaacaaaatgtttcaagttctccagaaaataatcctaaacctcaacttcttcaagaaataatcctaaaataacctcccatcagcttctttgttactcagtattttattcttaacttattgtaaccttgtacctatttatttgtcccttgggagatgatggttttctttaagagttatgagtgtactttctagtgccaaacttgggttcaaagcctagctcatccacccacaagctttctgtctttaactaaattatttaatatcactgagtctcagtctgttcacctctataggcatgataaataatgcctacccacatgatttcggtaagaattgaaggctattgtaaagtttaaacatgaactaaacaatcaataccagcagctagtaatagtggttctgccaatattagttaaaaataataataatagtaagtttgttcttatgccctggcatactctctgggagaaagaatcatcttctctttcttaggttattatttctttttctctcccctcctacaactgcacatctgcctcttcccttcacagtattttgcaattctctgtgtgactcaaagcagagctcaggttatgcatgacagctgcctcttccactgtgccctggcaccatggatgtcactgccatcctccaccccatgcatgagccagaaccctgggctccttctgactcaccattctccctcacccccaccatacacagttcatcaggctctgtgaatccacatcctgaacggctcctgatgctggccattgctctccatgtgtgccatcaccttcaacaggttacctgcatctccaacccagactgccaccagagcctcctgactgccctcctgaggtcgcctgtgagaaataaaaatggaatcctaagccccccaactgaatggaccctctattggccaaggggaccccagattaaccttaaaaattgagttctcagccatgacaggatgagaggtcagacatgcctcagtatatccctccctcgctaaccatgttaggctttcctccctaagggataaacagaaactagctctttggaaagactccacttttgataccaacaaaccacctgatgctgcccctcctttttttgcctgagaaaagaccactgaccatgcagtggttctggccagtctatggagaatgtgcagtaaaggcttttgtgtcctctgcttcaccttttgacatcagagagctcaaaactccacccttggatcatgctaatgctaccattttttttgtacatgggacccacaaatgggcatgaagttcaattgcacaggaccacgtttctcctttcatgaatattcatgactcctcctatagcttattaaatatgtatatttggccaccttgctcagcgcacgttcctattccctttacctctcccttgaagtgtctgtttctagcttctggcaagaggctatgcttcctagcctgtgggaatgggcaccctgcaggctgcaacactttatgagaaataaagctgttttcccaaatttatgaatcttgtcattcttcagttgatacttgtctccctctctgcttctcattactgctcaattctccactctgtagctggaggggtcttcttaaagcataactacgatcatgtgaaacccccaccctaaggccctctcctggcttccccattgctcttagcatacacatccaagttgttaaacatggctgtttaataatcatgcttattatctgtgctggagccacactgactttatatcaggtcccctctttgcataggctgctattgtttcctccaataagctctccaaataaataagccttgcataatactgcttaaaaccaaagttaagtcctgaactctgaactaggaaggtctctttttagttcaggatactgtatgtcactgatataaagcactgtgtggagacaagtctcagagaaaaagacgaggctggcagaatataagagaaagtgacggatggaggaactggatgcctaaaagcacttcatttcacttttctaaatgtgccctgtcaaaatgaagggagcagacccagtaaggctgaagttagtggttgcacaataaagtagaatatttatcttcgctctggagctgcagaccattagcattagaaaacaccaccaagtctgtctcctaacatgcctggggccctcggaatggggaggatcctgatttaatgagcaagttacaccatctgtcaacaggacggctgagaggtaattcagccaacagcagctcccagaatttaaggagcaaaacacttgtgtgctatttgtgtaagacatggcccctagcttcacggtcaaggaatcctacgcaccctaactactcaagctgggagtgaggggtggtatctgtgtgtcttgctcacagtccagccagcttcagcttttttgtgtgggtgcttgatgagctttgcagaagggagacatccagctagaaatagggtcctggagagttccctctgcccccctttctgagcctaataatttctggcaagaggctacaacacgtattaacataaacaatatcactggccaaagtattcacactgttatggatggaaggaaggaggtgacagaagagagtatatttcatgtatattccttgtgagacacgattttgaaatggaaataatctaagagaataaattttgcacctagattagtgaaagcaacatggagttgctttggaaaatacctcagttgtaaaataatgtgatcttttactaaatgaactggtaattaatatcaaaatgaggaattttttccctgtaaaaattagtcaacttggaaatctatataaattcttcttctgtatttctatagctcattttataatacttattaaattttgaagtttacggatgtggggattttttttttttcacacacacttgtgagtccctaggccagagcttggcacacagggaggtagggtggcaaaagtgtatggacccaaaagtcaaataacaggaaattcaaatcccagctctcttacctagcagtatgaatttggtcatatttcctaagcctcagcttcctcatctgcagaatggggagaacaactatccatttctccagggttgatgtgacaattaaatgaaataaataatataaaatattactattatctgtaacacacaggaatcactcaataaatattgactactgttagatattcaagtgaaaatattcatttcagcataatgcttttatgcataaattgttgtgaaatcatcttgacatcctaactcccattgttcaaaacaaacaatataaatttgggtaggatttgatatgaagagacaactgaaaatcagttaaatataagcctggtatctatgaacttcttgactgtcagctttgagtcttactctcttattctcctttgaagctataatatctttcacagtgcttggcactcagctccagaagctataatatctttcacagtgcttggcactcagctccagtaaatatttatttaataaatggaacatttgttgaataaatcacggggtgaataaagtgggtgaacaatctgaacaatcacaagcaattttacttagcttgtttacccaacctagctttaggaatctattagaatgctatcaaaaagtagagagcactggatgcgggaaatattaataatttttctagctttccttcaccacagctgtggtggacatttgtcatgctccctggactgtcatcacattctgaatacctatcctatgtgcatcagtttcccattgctgctgtaacaaattactacacatttagtagcttaaaacaacacaaatgtattatcttacagttctggagctcagaaatctgaaatgaatcttaaggggctaaaatcaaggtgtcagcaggcatgtgttctttcttgaggctccagggaagaattaatttccttgtcttttccagctactggggatcttttgcatttctggtaactcccttccttcctcttcaaagcacatcaatccaacctcagcttctgttctcacatcttctttttctgactctgatcattctgcccctcttttataatgacttttgtgattacatttggcccacccagataatctaggataatctcccaatctcaagatctttaatcatgaatgctaaatcccttttaccatgtaaaataaacatattcataggttcctggcattagaattaggacacaaacatctttgggaggctattcttcagccaactcactatatttggagtatttcctgccttttgtatccagtcccacccaggtagaaacctgtactttactttggacaggatgcaggcatgtgactgaacttagtcattcagatgcctgagattatggttctaaagtgaacagcatgagcaagcaggtttgatatcaaatccatcttctggtgaggttggtagcagcagtgtccagctttctggataccaatggtgtatagagctcagtccacaccagtgatgagatctggctgtttctacacagcagtggcaggagtctttttttagagcaatgccataatatacccttgtaagtacaatttccaattactattttttggcctaccctcagactctgtgagcacctcaagtgctttaataaaaaattttttctgcttatagtagtcctgaaggtttcattatttataactaaggaacccagtggacacagcctcctgtgctaggttgtaagaagcgcttgcagggaggctgacggagtgctcctagaaaattggaacagcagacaatcatttggggcaccatttaggtgccaagtacttagtaaaaaaggccctgaagaaatggaatgcaatcattcaaactaggagttggtaaattgcgctgttctttataatacccggtgtagggggaggagagaaagagaatatcctatggaggtctgttctgagactttgatcttcatctcttctcaatatgacagaccaattcagatagaattctgtttgtgaaggaacagcaagagagattttgattactgattctggtcagcatggatgcacccctcagtgattttcaaagcactttatggcctttagttgtttacattaaattaaatagtcttggatatccattagtttagaaagcaaaattatatctggcttaaaactgctttttgcctactgcctcattcgcctctgcattatctagaacttgctcacatatggctcttactttatccatctgtaagacaaggtgatttttttttttttttcgaaataatgcatttccatccctctctgttcggtgtcttttgcttgcagtttggagagcttggttcaaatcctaactctagcagttagtagctgggtgacttgaactagttacttaacctctctgagcttcctttttctacaaaatgttgataatatactcccaaacagacttgtagtgaagattgaataagtatgtgatatggtggctgagctcagactctggattcagacaggtccacattcaaatcttagcttacatcttaacagctgtgtgctcctcagtgttacctgggtgcctgtctcctctcaatagaatcagagatggataagaagtccctcatagggttagagataaaatgagataataaatggacagcactttgcacagtgcctgttaggttctaatattatgaacagttaagtggctgtttggagtgggtgtttggagtgaattaaggaattatcaaacgaaagaataaaatcaacttcatgttttcaaacacccccaccaccaccttctctcaacacggtctctagtgatctgaaatcctttctaaataattgtttaaaagttgttaccactaacagagatcagatctgtggttgcctgcacaaggattggagagggactgactacaaagaaacatacagaaatttggggagtgataaaaatgttccacatcttagttgcggtggtggttataggactgtcttttttaccccaaactcatcaaaccatataattaaaatgagtgcattttatgtttaatgtacttcaataaaagtttatattaattaatgtattatgcttctagagcaagggttagcaaacatttttctgggaagggacagatagaaagtaatttgagctttgccggccttaggctctgttgcagctactcaactttgcccctacggtgtaaatgtagccatcgaaaatagatactagacagtacataaatgaatgagtgtggttgttttcaatcaaacacaattcatgaaccaaaatttgttttcatataattttcatgtgtcatgaaatatattatttcctcttttgatttttttccccaactatctgaaaatgtaacaaccattcttagcccctgggccttacaaagacaaggcagtaggctggatttggtcagtgggccactgtttgtcagcccctgctctagagttccaaagaggctttgttacgcagcgttatgaaatctgctttagggacttagtgcaaataccatgtctaagaggactgggagtccagctcctgtgagccctgtagggtctttgccagaacccactctctctgtggccagcctaagccgctgcttcttgacttcaattttgccatctgtgcagagaggacaacaatcatctctcagagcctggtaaagctcattcagcttgttatttgagagaaaatgctctaccaagtgcagaagctgatcatggcctgggttatgagtctggcctgtctcaatcatcagggggaaagtttgatttctcaggttgtcattcctaaaattgcttgttctccaggtgatgttcttatttctgaatatggtctgaccttcattccccaaagagaagggttatgttttcaaagagctggcagaagaagagtactcagaaagcttgctccttccctgccgaactgccatcccagcacaaaccatgccttaggggagggtgactttcccccataatgtttacctggatgggaccagagctactctaagctcctctgagagcaaagggagctttataaatgcaaaccagcacaaactgaggtttcttgtttttggtttctgacagtagaaggtgcttgaagcattactttggggtagtaaaatggccaaggtatccacaaaagtcaagacagttctgaggttcttgaagcttccgagcttttaaaaattgactattacatgtaaaattcaatcaatcccttactgaagaaaaaatcattattcaggtacccagtttatcctcctacctgttggaagcatttgattcaactgtttctcagaaatgtttttttgtaaagaggcagagaatacatgttttaggctttgcaggcagtatggtctctgttgcaactactcaatgctgctgctgtgatgtaaaagaagccctagacaatacatcaatgaatgagcatgactgtgtcccagtacaactttgttttctaagttgtaaacaaacaggttgtgggctggatttagtccacaggctgttgtttgctgagctctggtctgagttgtgttatatctagaagggacttggtggtttagggaagagaaaaaaacctaaatcagcagagactactggtgagaatgtggaaaaacctatcattacggattggagagtaaaacccaaccaatgagcatgttgcattaggagtaggatggggataccctagatgaatcctggccatggtgaattttcctgatgaaagtagaaaggcagccagtggatgggcagcaccggggacaagaagagccgatggggcattatggggagatactgctgctggctggactgctcataacagtgttcacaaagaagcctctggttgaacatgtgagaacctatgagtaagccatgtaggattcaggtgggtcaaaataaggtaaaaaccacagcatgagcaaaagcacaggtaagtgtctgcaaggtgccttcacagaatcctgagttggaaattggagcaaagttggaaaggtcagtctatggcacatcatggaagactttaaaacatcactttcaacagtgtgaactcttcatttttaagagtcagtgacaggtactgaaggtttctgagcttgtagtaccatatcccctacaaagcagctaactcaaatagtcttcctcctttacaaagagactatggttggctgcatctcacatgttatgaatttgatgctaataccagatcacatttattaagccattattatgtgcctgataatactgtactaaatgctttactttcatatgtcatttaataatgcttataaaaaatcactgatggggttattttttttgaaaatacttggaaaatggtttaatgatgttttacaacagaaatgaactgtacagttatggtaagtttaatatatatataaaattacagcagacaaatgcatctacacaaaatctaccatttcattctgattcactgtcacctacacaatctttcccaagcctacaacccctgcaggcagccctaggagggggaatcatctaaagggcacattgagagagacagcaccgctcatattcctcacaacctcctcaggcctcaggagctgatggggttatttttatctccattttacagattagaaaactgagatccataagaagttaacttacccaaagccaaccagcttgtaagaggcagagtgtgggtttaaatgcagctcttaatcattctcaactcaagctatatggcatctcagtggatttaaacatatttctgcattttaatagttaaataaaatacttttaacatcatttctaaattgtttctccagtgttccctctcctcaaagatctccaatactataattacatttgtcatccttttatcttcctatgaattattttttaagatcaccagattaataataaaatatttgtaaatttaaattttgttcaaatttaatacaatcccagtgcactgctttagtattaaatcttgatttccatcaatgacatatctatccatctatgtatataattattttcacattatttgggctatattttaggaggatgttgctttaatgaacacaaaccatatatttatctgacatgaatttttggccacacacaataatgtgatataattttaaataagtaaaaaatgcttatataagtaaaagcttagaaagaaacaaaccagaatattaataatagttgtattatggttatgtgattataagtgatctgttttttctcttttttcccaattattttaaattggattatgttagtgttaaatttttaaaatataatcatgtgaaaaatgttctttttaaaaaaagagaggttataaaataatccagtgggaactaatcagcaactaatgaaataatgcccaaatgcaaaaagtgatgatgttccatgaaggttccatgtacttaaagctactggatctcattaaatcactgggacctaaaatcaggctggctggggtgggtctacactcagcttctctaagtacaatcaatttaagagaaacaggagtaggggtttagtggattagtcacagcaggccattaatctctgcattctcagttgtaatccagcctctaccaacgagcttggaggaaaaaaatcccacaaaaaaaccaaacactgggaaaagctctaaagcaggctccctagagacagacatactcaggtcacagtttgcttgtctttacttaacatcaatacagtatttatcatctgtcctatttcttgttggtttcccttttatgccttttgctgaaatgctcagatcagatatatttgaaaaggaaccatactgcaatctcaggaatagctcagcatttaattatcatttaaagaaatccttctctcaagtgaatatgaaacaaatcaaagctatgttttcatgttgagaataggttgaaaaaaacatgggtaaggttaccacaaacacaaattagtgcttggggaagcaggtaagtctgaacaatgaaaagggaatagagtagccaaatttcagtaaaaatgagtgacagtttcaaaaattgcagggtaaatagtgtatcttttatcataaatggattaggccataataatacctcacttctttattgctctggcaaatgatctagaatttactaatgtattaagtgggaaaaaataataagcaaattcctgagccagggttctatttatgccactactgtcaaggccgaatatttattggattatatgagaccatatgcctacattagaggttttgataaatttaaagtgcagttgtaaactaaaaatatggggcattaatttcttaatttttaaaaaattattaaaggaacatatgggcaagacccagtaaactgtctctgaagatgatgctatgaaaagacatgattatctcccttcttattacctttaaaatattccccaaacattctagtttcccctagtgaatcagattcaaccaaccttaactgattatgtgctatgtgcagacattgtgctgaacactttcacatgcattggctcatttaatccccatgttttacatgatattgccaaattccttcctaattttgctcaacgtgtcttttattcttttagcttcagccatatcgaaagcaaaagccaccatttatcaagtgcattctatatgccaaacaccaggctccattttttttatttcaagcccgcttaactccaaaaataggtgttattgcctccaatttacaaatgaggatactgacacttagttagagatattaaataacttcctaaagtcacacaataagaaacatcagagttgaggttaaatagtaagataaggtataacgtataatgttttcgatgaatgctcttcaatacatctgtagcagtcaatgacgacccctagactctttcccagcgttgcactagagggtgacaaggtaatcattccacaaatgttatttgggttatttttctcataatgccttatcatatgattgcccatatagaaagtcattttccactttttgttcactcacagtcgtgaaagatcttcctatattttcatcttgttgcctcaacatttcaaaaactggggaagtttagcatgaacagcaaatttggacaactttctgtaaaagtctcttaatatactaaagttcctaagttggaaagggatctagaaactacttagtccaatatgcttaaactgtttaaaaggagaaaactggccccagaatagtaaaattaattcctccatgccacagaagtagtagtggcaaaactaacactaaacacaacatgtcctaacttccatcctagtaatctcttgagcaaatcacctaattctatcttccctataatgtataaaaatgtgctccaagaacaatacttaagaaggcttaaaattctagacctagaaaaggtatttgtttatcttaaccacagtttcctgtctctgatctaacttgttatgcaaaataacatcttgaatcccatagctatttaggtttgtttaatagattttgaggtaaaccattgctgaaaggatgtttgaaagattagtcactattctacatacttgcttactctctcaaggaattcaagcacattactagagcctcataaacaggttatacattactttcagatataatacagtaaaatggtaaggaacttcatactgtttgacccaataatcacaatattgagattatttttaaaaaaaattcgataaatatctacttggataaaaacaaatgccaaaaaatgtcataaactagaaacaacatatatgcttaaaaacaagggaaagttaaatataaataatgctattttacatgaataaactactatggaaatataagaaaaaaataatgcatattgaagtagcagatactagctaattgttcgcaaaccattttccctttgctcctggctacaaggctagcctacaactctctaactgctttaaaataagatgttaacaggtgcaacacaccaacatggcacatgtatacatatgtaacaaacctgcatgttgtgcacatgtaccctagaacttaaagtatgataataaaaaaaaaataagatgtggctggctgggcactttggttcacgcctgtaatcccaccactttgggaggccaaggcaggaggatcacttgaggttgggagttttagaccagcctgaccaatgtggtgaaacaccatggtaaaaaaataaaaataggccgggcgcggtggctcacgcctgtaatcccagcactttgggaggctgaggcgggcggatcatgaggtcaggagatagagaccatcctggctaacacagtgaaaccccgcctctactaaaaatacaaaaaatcagccggccgtggtggcgggcgcctgtagtcccagctactcgggaggctgaggcaggagaatggcgtgaacccaggaggcggagcttgcagtgagccgagatcccaccgacagagcgagactccgtctcaaaataaataaataaataaataaataaatataaaaaaataaaaataaaaataagatgtggcaatgtgactgaccagaaaggatgcccacagcttttcttcttggcccacaaaaacccctcccatggtcttcctctacactttttttccccatctggtgatgttgatgcccaggaaaactttggaaaccataggaggtagcacagcccccatcaaccttgtgactcccaagtcaccactaaatacagaattttttttcttttatctctttcctctcaccaagcacctacatgcccacacacatacattgacatctattggacaattaatgcaaagaagtaagcctccattgtgttatgtcactgagattgtggggtgtatgtgtcagggtccaggatatgctgaactgacacaactaggaagcaacatggagaaatatttaagatataaagtttctttttacagtacaaattggaaaagttacagtttcaaaatttagtaaacaaaaatttggtctatggggaataatttttttcctaatttttttcataatattttatcatatttggcataaaatacactctgattccaggcttcactcatgtctgtgacactaaaacactttgcatatacagtccctgtcttgcaaggagcactgatcaagaaagaacatctgagttggatacgtaattggcctaaacaaccaaggcataaacacaactctcattcatgaagttgttcaacttgtctttggatgtggcacattatatgcctttacctggcttagtcaagctctaatttaagcagttctaaaagcagatttaaaaaaaaaaaaaaagcctgcactaacttatacacttaaaattgcatgtggctctcattcaaccaataaaactcagtgctaaaacaaactaaaaggccacaaggaacttcaccacagtagaaaaacaggaatgaaacttgttacagaaataaaacataatgacttcactactttatattccactctacaggggtttgagtcactgtaacttaagagccagtatcattatggtgcattacaagacttagacatcaagtgacatatttctatcacacccaggtcatacaatagaaacttgatactcaccgatgtctcactttaaaatccccaaacatccactgagaaattaacaatagggccccttttttttctataacccctttttatttttttctgtaattaagattacaagcaaacaacaacaaattatccaattgaccatctcctcacagttgtaaagattaaccaggtgattacagggtgaattcacagccaaggacagcaaatccactctgttctttcaattcctaggctgccagctcttctctggtaagaactagtcagctacaccacaattctgttacaaaaggccagaggggaagtaatgttttctgacacaagactgaaaacaccatagagaccacagtaatttcctgtattgctctgcatcaagactaaaaagtggggtaggctattctccctaaagcactctagttcaacacactaacaagggaacagtgagctttctaaagtgttgttttctcccaagtaggaacttggtaagaaatagcgtacatgttccaaacaatctcctcaagtaggaacagagatgacatggagaaaagaatgacaatgtatccactgatctttaattgtcctagttcaagcctttggtatggtgtcataaatacaaaagggccgaaatacattttaaacaactataagtgccccaaataaggatgatttgtcaaatggaaatatgagtcagagcaggactagaaaactatcaaacatattgctcattgggaaggttcccattctctgtgactctgcacactcaaaaacctacatgcagtagaagcaagacaacagctggtagaggtgtcttcttcatctcccctccctcatggcctcagatcttgtccctcagtctgccctgaatgcagaaaagccactctccatcgctccttattattcatttatgtattaattcagtcattcattattgagcattttctaaatgccaggcactgggttgggtaatgggaaaaaaaacactcacacatttgtgtgtcactacacacattttatagggcaaagaccattgctgttttttttactacattttatcttatgcctggcccagtgcccacctcataggaggcatttgttagcatttgtgcaataaattaacaaatacatttaacactgggaaaaaaatcttccatatatattactttattgtttatttcaagaatcctctgaggtatttattattattctaaccttgtgttggaggacaggcctatgctccctcaataattgcagctatcagaattgttttccttgaggctaaaaggtagctgtgtgtgtagtgagagagaggggagcggaaagagaatatgttgactcacatccttcagtaaatctgtttattccaactctggcattgctgccaaatgtgttgcaaagccagcaagacttggctctggaaaactcacctgaaagtcacaggcctcatttcctactgccagccccttcagccaccaggcatgaagtattggacaaagttaaagattaattcttcatttactgtgacaaaattaccacttctcccagatcagtaggcaaaggcatttgtatgctgtgtccttcataacctttgataatctctccactgccatcctgatggcccagtaatgcaaatgtaatcaaaccccacactggctatcccgttaccagcccaatcttgctaataaacagcaattgtggctttgttataaaagtgatcctagatcatttgtcaccacccaaaccttcccaccccaacccctgactgctggaaatcctttaaaggtctgtttaaggttacatgaaataaaaactgcaaaaaagttacagaaaaccttcactaatcaatgagtaagatgataatagatataccgtaaaatccatggtcaacagggtcctggcttttttttcctagggtgtaaatatgtgacaataaactaagtaacaagatgatataaactctgtaatctatatctgggttattccaaagcttctgggaagccatctggaaccagggacaacagtggaaaatgatcagtggtctgggccaagtagagcatagctgaacaagagccaaagctttaatactgactggtctcttcctaatgaaggatgcaaactgcatacttccttgggcctttaaaagatgcctttcatgcacagagggaaaatgggtgatttttactgacattattatatgcaagggattactgttattgaaattatataccttaaatactcttccatctcaacctcatccatcacactacactctttagttgtgactatgttcactttttgaccgtctcctgaattaatcatgtcctatgtctcatctaatctcccttcctttgcaaatgctgtttcatatgatcatccatctctcatcacaaccctcttggttaagtagccaaaatcttccacgacaactctttaacatccttggagactcaccctaagcatcctctattaacgctacttactctccttctctacccctcctactttcaggatgagtcagatgtcccttctctcttctcctcaaacactttctatacctttttattacaatgcctatcacattctgctgtgactaccaatattttaaaaatcagtcttttactagatgaagaatttttggaggaaaaggtcactgtcttacttattctggttggattctgagtacctgatgtataatgtatcctcaataaatgttgaatgattaagtggacaatgaaaaccatttcatttaggtctctacactcattttatagtaactgaaccatagagtgggtaaaatggatatatcatttagttaaccatgggtatattctgttaagtgaatgtgtactctattggaaataagagttgaacagaatgtagtaagataaaactgctacacaatgctttgtagtactttgagcatctgttttatgtcaaatagtgtatctattgcttaacccataattaatcttcatgacaccaatgcatgtacagatgattcatttctcttagccttcatctaatgctaaagacattgttattattattcaagtacaaaattgaagatatttgtatttgcttaacctgaaaataccaaatctcaaagatcaggataaatgagggtcacgagagatttataaaaaatgaatttttaaaaaagtgtatcacttagaatgtcccataatgggcaaattgatctattaggtcaggattttttttaatgtgttttgtgatcaagaataaatgttgacagaaaaagaagacaaggagttgggtttctaagtaatttcttattacaatcaaagtaaaaatattaagttgcacacaaacctgattacgtcattttccttagctccccattagctagctcctcataaataaaaggtaaggtctaatcttattgtggtttacaatccccttcacactggcctaaggttatttttgtaacccctatatccagtcgtttagtctaacctatccactccatatgcccaatccaccatactttgatattttgttttttaaatatcttcttgtctatgaacatactattcttgccacatgatatgtcttctttctccctgttcttttgaaatctcatgtgttcttctaggtctaggtcaaatgttttctataaacattttcccttctccacttgtatctacaaacgacagagttaattgctcttcctttatacttccagtatactttatacacatttctattttacaacatgtactctcttgttaaatactaaggaccaaatattgttcatttctgtgattccagtgcctggcatagagtttgctgtcgatacgtctttgttgaacatagaataaatgattaaataattaattggcatttacaaaaactgatccaaagtgtcaacaagtattgttattgatgtcagtgatgatgatgatgataattttatgggagcaacttcaatttactgaatgattaatacatgtcaggcagtatggcagattcttatgtacattttctatacctcacattttacagatgaggagttaaggcacacagaacttaaattacttatccaagaccaaacagagagtgaatcccaaagttagaattcacacgtctgcctatctgggctccaaaacccaggcttactctcatatgatgtgtatgcattggccaatggctactgtattccagataccacattagccattttacaaatggtgtttttttatccttataattaccttgtagaaacaacaaccttgagaggtaattatcatctctgttttacagatgagcaagctgagaccctacctccagccccctccagttcaccccctacgaaaaaattccaactcaactgtctacaatctcaaacaggctacaaactatataaagtacagtgctagttgtagacatgcaacagaaatttaaaatccaaagaaatgttagaatttcaaacaaattttaacaaagaatccattgaaccgttgcaaagatccttaatacaaaaacgaaagtcacaaagtgaataaccatattaggacacttcatattctctcaattcaatagctccctaagtgggctcatcccaactttccagtatctcccaaagtgaattttttgtttcagttgggacattctttagcgtacatcctcttgtttctattcctcctttttgatgatgaggtcccctctgtctctttcatccaaacctccaaaatcaatctaatatactccttttctttcatgtctaaacttctcccttctatacaatttatgccaattattaaacaattagacattattcctattcctttatatcacaatgcattttagcattacaactttgcatttataataatatcttaacaaataaacattactcatattactttatatcattctaaactatgtgtatgtatctcaactttgcttctataactatatcttaagtatggatcatatatagtaatgacacagatgctttacacttgcataatgcaaaaaatatttattcaagaatcactctctgaagtttccctcagcaatgctttgaaataggcaaagcaaatataatttttattttacagatgaggattgagattctgagaggtaaagaaaactgcccaaatttataaaggtaatgaaggtagagtcacgttgaaggataggtcttctgatttccatactctttctataatggcttgctatcatacacatttatgatacctagatctctttttgaccttagtcccaagtatgtaatgcttaattaaggtgataaactgagacattagttactgacttaggctagtaatcaaacccctctccccagccaagggactgggtattcacatcaacatttattttttcccttgggatttcatacaactccaaaagactttcttgactcactatctggagagttttatctatgatgatggttatctgtcagtaactgggctatatgacatcacatgggaaactggatttaaagaaaccacattgctaatgagatcatcagataaatagtcattgtaagggtggggctttttatttgatgggacattctatttcaagccatattgaaagcatatgtcgtttgccagtgttgaggcactttaaagttgggtctatactgcattgtaatatacaactgaaagaaaaattcgctgatcccctgggtaataagtactacatggtttccaggtagtttagtaaactttccaagcctcaactccatattggactcatagggataaagtgggttacagttatgactatgcaccaaagcttaatgctaccagtctcatttgtatgagaaggaaaattaagagacttttcaaaattatttagccaaggcttcctggaaaatagggtttgtgctcaatgttatagatgtgcttgctgatgatggttttctttttgcttttaaacaagttgatatggaaaaaggtaaaagctctactccaccatgaaccaagcctatacaatgtcagatttgtaggaaataatgacattattgcatgcttactatgtggtagaaactgtgctgtgtgaaaatcattggacataatatctcatttagttgatagaacaaacatgtgacacgtgtactgttatctcttttctacacataaggaaactgaagttatgccattttaatgttaagattaggaaaacagtgtaggaaatattccttgcttgtagagattgctgatcctaagatgctagaggcatttgggtaatagcctcatctgtttgattgacagggtaatgtacaactcaaatgctaccttaattctagctctaaattgtaatcatctaaaacttttacttccaaattctctaagacttcaattcatttaacctaatttattctttcagagacatcaaaataaaaaatattaaataaaaatatttgaaaggaatcttgaaccaaaacataaatgatatactgaattttgactcaggtagacctggatgtgaaacctctagtctgaagctctgtgggctttggttgctatatctataagattatcccacaaattctaagaatagatgaattaaatatgtgcaatatatgtacaatgtgtgaaaataccacataattcaaatggttattgatgttattattatgaataaactgacaaagaagtaaagttacataaggaggaagtaggatgcattgtaaaaattaaatcaggcagctctcgtttgaccaagaaatttctctcctcgtgctgctaagcatacattcttgctgatctgagctgctttggtaggaagggaatggtgctcttgcagtacacggaaaaatcattctggttctctctctctccctctctctttctgtctctgatctcttcacagaccctggatgccttacattttcagaaaagtgagatctgagtttaacggaaagccagaggaactcccaaatcatgccctttagcctagctatgttgcattaagtagccaaagctgatgtgatctcacaaataaaagacatacatgctactgacccagcatctagctaagcctggccaaacagtctcattttccaacagtttcatcaaaaccaaattattagtgcagaaccaccaaatatgccaagcccaggtgtctgtactttaagcaatatatccaaataggcccaaggagaaatttgggggtgggttagaggaagtgttggaacctttggttaacaaaacactaagctacaaagcgccaatgttttcctgaaagcaaatgccaccaaatgaaattcagtcaatatatcttccacatgacaaagctactaccaacattttccttctgtaaagtgtttagactacagacttttactagccttttccagcctggtgtttctcaataatgaagccaactctatcaatgcttcaagtatcaatgtctggtaactctgtaaggattagcacccacttagtggtcaggaaaattcattccaagatgctaaagaggtgctttgtttttaatatttttaatttaagatttagtagattctatgatcacagggttatgttcctttcaatagagctcagtcatgagtaaattaaaactgcaaatcatggagacagaaatgaaagatccactaaactctctcaaagccacaaatattcaaccttagtgcattgcatttcctatacatcctaaggctgccagatggaaaaagaatggagtctgagtctcccaaactgtagcaattgtgagtcataatcatattactaataataattctcacatacatgggcattactgaatgagtggctctgcttacaggaggatgaggccaccctgaccatggagaagaaatggccttttaaagtttatggatgtgtaaaataaagagtatatgatgttgcatccctgcctaaatgtcttcataaagtgcaaattaatgcagatcctaactaggcatttggaacgctaacctagttttctgtgtttagctaatagctagcaattttgcttacacttttatcctctcattacatagcaataatgattatttagtaaatacatatgaaaggccatgtactccatagcactcctcctgagttggaaatccccctcctaatgcttccatttgaataatttagttgctgatacaccaaatcaaatatagctgtgacaggtatcccactaatgctttttttggaggctaagatcagaccctttctcagcctgttcccctcggtgattgcctggcgaaattcagggtaagggctggggacagagaggatgctggaggaaatccagagccttaatcaatgttaaccctttataaatcttaaaggtactcagatggcttgtctgatttgaaaattattaatgacactggggagaagtaaggaaaggctattttataactagtcaaatattctggaacaagagagagagtttgaaatagacatgtagaagagaaagatgtaaaatatggccttgtgagatgccacccacttcatatctggacatatgactgatataaacctttacaagtcacttgagaattttcactcctagatgcagaatggaataatagaagtcccactagaggagttggggtgaccccagggcacattttcttgtctgccaggtacacaacacatctcactgatgtatcacagagacaaatttcttaatagggtagccaagccccacacagaatgatttcggataagagtcccattccttccctatgaggagaaaattggaagccagactgggatttggaacagagtccagggtgagggcagaactagggttgttttctcctatccagaatcaggtctggcttaaagggaggggattgacagggctgaaggaagaggcaggaaacatgtctctccaccccagtgctgcttaaatgtggctgctcaaaggggcaatatcctgctctcctcttctgatgacttcatgggaagttggccgagtccccacttctgcagaagaatgcaggcagaagggagcactacaaatgggcttttccttgggtgcttaagtggcaggtgtgaagggaaatggggtgggtgccttcaatgggaggagccactgaactggggaatactgctggtccaggggctttcccctttccctcccagcttcctcccaaccccaattccctgcatcaacaaagacagtgctcaaaaaccagaactcgtcctaacacactcaggcacaggtgtccacaagcccaacctctttcacctcaacaccctgaaatcccgtttgctcttaaaagcacagacaggcccaagtagactgagaggtctgagccagcacatccttgctactgggaattaaaaaacaccgtgatgtaaagaaagtggtatttgtgacactgtagtgctttaacaagaaaattgggggggtagaggagggtgtgtcagcaggtttcaaagcatcacaatcagtcctgatgtgtttgggtaaggcatggaggacatatctctgatccctgctggtactctccagtcccgcatcctcccgcagtctcttgaaagtggttagatacccgggcagggccccgcgtccattttgccagccaggaaccaccgagtctgggaactttgaaagccaggggatgggggtggttgttgccaaggctcggatttcggcgccagagttctcagccaggaaagcagttgaaaatcaacacccatctgcctcttctttctcatcccccaccactttttccttcacccttctaggactgcacacagatcctaaccacccccccccgcaaaacacacacattcacacacccttgggctgagaagatttttgattctgaaggcggcaaacccgcagaactcaaagggtctcgccacccctctctctgccccgcggctatatacaataaaaccccatacaccccagacatcacaacataatccaaatcagccagtgacttcggcgcgtcccgtacctgatatgcagacgatgaaattggcttgaagaagaaaaagcacctcccagactatttccatcctctgattctcattccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatgtgcgccccagatgtgctgacacatgtccgatgcctcgctgccttggaggtctccccgctcgcgtgtctcttctcttcgcaccagcggcggaaaccgcactagcagcggcggcggcggcggcggcggcagcagccacctgaagccaccaacactgggctcttccagcaaaaacgagaccccgattcgtctggcgccccaagaagacatagacgatagccccccgccgggctgcgccgtgcaattccgggctcccgggagcgcgtagctcgctggctaagcccaggcagtccgcggcaagttgccctcgaagtccgcccccctcaccggggcatggtcggagggtggctgctgcgctccggggcagttcttctcctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggcaggactcatcctgggagtgctgtgctgtgctctccctccgctgcgaaatattggagatttttttgcataattcattccctgccctctccatttcgtccctctcatgccccccaccctttacccctttccgtgccagtgccagaacactacttaccccagagttcttttctctgcaggttcctagaccaggtgcaactcttgcctgcaagtccctgcctccctcctcccgaaaagggggaacaccgcctttccaagtccgggtgccagcagcggctgctgccaactgcgccttcgcccaactccaggaggatccgggactattggaaacccgggctttagaggaacgggcttcccttcttgtctttcttttattctgcttttctttagggaagctctagtgctttggaggcttttgctgggctccaggatactttccgccaacgacactcagcagcttccactgaaggagatttccccaccaaacccgcgcgcgcacacacacacacacccagcgcgcggctctccagggccccaggggaaagtaggggcggcgcgagcaccacccacccacccaggccgaggccaggggcagccagtccgcagaaggtctcgtggggaggcgggctgtctataacctaggaaagacttgcacccggttgcagtgtggatgcaggggaattgaa

SEQ ID NO: 1499 - DNA, 529704 bp, Homo sapiens
tactgggtaacttgttaaacacatttattgatttcttgacagtaaccaaacacagtgagtgaccattataaacaagaaaagaaaggcattcgttttgtactttgtgagatctggctgcacctggagagaaaacatacccctttcccaggaacttacaaggcaaagtgcattccttcacgggagcatcacaggggggcatggcagttttgaaacgcaagaagtctgtcgcctgctatctcaggctgaagctcacctcatgtgaatgattgagccatggagtggaattaaagtcatacttgcttagcaaatgcattcctgattgccacaaactcagtaaaaactggctgcaaatgaacaaaacatgtagatgaaggaacaagtgaaatcaaagaatgcagttgcatggagccagggcttagcctgtaaggaaggagaacagaccaaagccagaaaaatgaaattaactcgttaaacacatttattgagctggtaacaataaccaaacacaatgtatgacctttggaaaacaagaaacagcaaatggatcatttctgatcttggcaaatcctactacagatatgtgacaaagagggaaataattccatttccttatagtctgtggtgatatatatacaatgtgtagctcttcaatgtctgtcctttttttctttgtaaattgttgagtaaacagaagaatcataatctagaaataagtgtccttggtcaactttgtcctgctcacctgctaccagcaccctcaaaggatcctaggacactatctgaaattacttgatgcaaagtccgtttgatgccatcagagctgtattttctcctctctcttttggaagaattttgtatgtacaaaggctgaaaagtctcattgggtagatttattagttcaggaaaacggtatcaaaattgaaatcaggttaactggttattttcttctaagacctcttatgaatgagacttttgtttctgaaacttgacttcccatgatggaggttgtaagagtgtgtgtgtgtgtaggtatgtttgcatgtgtttgtatgtatgtgcaagtgcttgtgtgtgtgtttgtgagtatgtgtgagagatgtattcctctgccatggttttgcagacacttttcatgaagaaagggccaatcccaagaatgaatgaggcttgggggaaagaaggagagagaagcaagaagggggacattctaggttacgtcaattcacagttgtagcatttcactgaggtgggattcttcttggctttgttccctacttgaggagccattcatttactgcaaagagagagaaagaaaaaaaaaatcacacatacaacataaaacgaggcatactcaattaatttgcacacagttttagagaattcctccagaggggaagggactgttttgtaaatgcctgcttacttatatgcattccaactactcccttccaattctccatgaccttctaggcctatactgaccaatatggtggccactagctgccatatgtggctactatgaatttaaattaattaaaataaaaaattagttgcatcattgtactagtcacccatccaatgttcaatagccacatatggctagtagctgctgtattgggcagtgcaggatagtcatcaacctatcatgaaaacattcccattaccacagaaagttctagtggatgacactgctctaggctagggatggaaaaacaacagtccacagatctaatccagcacaatacctgtttttataaataaagttttattggaacacagccatacccattcatttagatattatcaatggctgatttcatactacaatgtcagagtgccatagagattttatggcttcaaaacttaacatatttactctctgtcctttatagaaaaagtgtgtagactcctgttgtagaccatatgctctgtttggataggtgtcttatctgtcacccatcacccagctaactgacacatggtaggaacacaatacaggggttttgactaaagagaagaagcaatgaatgagttaggtatttacttttctggtagttccggctggaagggtgtggaaaatatgtagtttgggcatgcaagtgtatctgagagagaaaaaagaagggaacaagggggaagtaggaggaatgaagtggaggatcaaggagtagtggtggaggctgcttctaaaagctgtctggtaataaccacagccctcctatttggggagcatgttattgctacaaagggcttccctatccaggctcttgtttgcttcctttaacaaactgtgaagtagatggcataggaactgtcacgaagaagccaggtctagggggtaaacaatgtggctgggtttgcacagcttgttagaactaggcccagaacttgggtgtcctgatttccagtccagggctctccaagaccccatccttcctccatctttctttccacactgagtgtttaccacaatgattaacagatgtttagtagtaagcagaagggaagagagagagggctgggtgtgcaccacagagttacaggaggcagatgtcaacttaaatgtcccctttagtgggaataataaccatttctagggacatagcactgggcaaagatacactcacaaattaccccattggattctaatggcctgccctttagagtatttgttcatcttctaggggaaagcaggtctttcttccatatacttaaaagctctaatgcttttcactgtcctgttctaacagataaccttgggaacatcagcctttctgggctcttttgaaaaatggcaataaaaagctgtcttgcctgatctacaggggttttaaaggtttgatatatgtgtttaaaggttacatatatatatatctcacatatatcaaacctctacaccttgccatctacctaccgtccatccatccatccatccacttacttacctacctaccaacctacctagatgcattcatacaggtatctgtatcacatatatcaaaactttagaccttcatcaccatgcaaatggagtgtgatggctattgtcatttacagtcatcattcctataatggaagataatgccaggcctttaagaacaggtctaagcagaaagactgagctctagcctagatcctccactctctgagccaccaaacccacctctatactgaagcttctgggctcggttgtttggacagtccttcccctgtaaactgaagttgatattggtgcggatgcagcggttgttgagtggctggacaggcctgaagttgtcactcatgctcagaaagatctgagatggctggttctggctgagcaggcgcaaggaatgcatctgaggagagagaagtggccgtgagatccaaccatcctcttaaatgcactagggaagaaataagaccacagagactctggccaagctaggtggtattggctgtatgaggaaagggctgtataagccccacagagtcccttttttccatgggttcagttgagctgaaggcccattatacctccacacatgaagccagcctttcttctagcttactagcttgtgtatgcctctgaacaagtcacttgcgctctctcaccctcaaatgcagcatccaaaaaaggagcaaatctggttaggtttctctaaggttctttctttctttgatactctttggttcaataattccatgactcccacatggtattacgtggatcatagtgattggtccatgggtcagagctaaactaagctggaccagtttggtttcttttctgtgagactatgagggccaggtggctggactgtttgcagccatgttctgccacaggactgtgaggcaaaagaagacggtctctagcaggagagaagaatgaagtgaatgtgtggtgagaagaggacaacagagagaaagcacttctggggttcccatttcagtgaatttctgatgtcaatttctgattttaaattctctaagatgccctcgtagctctcaaataaatgctttttctaagcttaagtggggagttactgttgcctgtcacccagtgggtcccattcaatacagataggttaaggaacttcaaattgttcaaatggtggtcaggtgggaacacatatcccgtcaaggatattggcttctgcttcctttgctcatctctcctttaatttgttatagactcccacagtcgtagaatgtcagagctggagcaaactcatgtaatttatccccctctcaataaagaagaggagtgttcatttcatagaggtgggtgacaggcctgaagagcacaataagccgtgtagccaagctcacacaggaggacccatctgcctcccatccagttctgatgagtactaactctgtgagatgatccaaaaaaaacactgcacattcaaatatgtgtgcaaaatactacatatcataccacttcctcttgaagactgacacatatattagcatttaagaaggaccccagaaatccttcaacaatggaatctatttaactttttaaaacccaactttttcaaatgcataatgacatcttccattttgcttgcttgctttctgaacactgtagttgtagaatacactctgggaattaatggctatcttttcccactgagacagttgagatgcttctataattagctcaggctaagccttttggatgctggctctttaaacccaggcatatgggttgaatcgtgtacccctgaaattcataagctgaaggtactggtaacccctagttgctcagaatgtgaccttatttggaaatagtcattgcagatggaatgagctaagacaagcttattggggttaggctttaatggaatacagaaggtgcctttataaaaaggggaaatttggacacagagcctcagacacagggagaacaccttataaagatggaggtagaggctgggtgtggtggctcacgcctgtaatcccagcactttgggaggtcgaggcaaatggattacctgaggtcaggagttcaagaccagcctggccaacatgatgaaaccccatctctactaaaagtataaaaattagccgggcgtggtggcacgtgtctgtaatcccagctactcaggaggctgaggcacaagaatcgcttgaacccaggaggtggaagttgcagtgagccaagatcacgccactgcactccagcctgggtgacaagagcgagactccatctcaaaaaagaaaaaaaaaaagatggaggtagagcttggggtggtgcttttaaatgccaaagcacgtcaaagattgtcagcaaaccactagaagctaggggagaggcatggaacagattcttcctcacattccgctgaaggaagcaacgctgctgacaccttgatcttggacttctagtctccagaactgtgaggcgataagtttgtgttagtttaaactacccagtttgtgggactttgttatagtggtcctagtaaactattataataggcactccacatttcagtgatttttttttaacatcattcttctccattagctaaatgaccagagagaaactcacctgcatcctggttatatagacaggtttgttcattatgatccaacttgctgtctcatagcagggtgggatagtcatcgacccatcgtaagtgatgaaactagaggtctctggatatagttcctctatattaagcccctgtagtaaatatgcatcatctagagaaggaaagaagacttaaaaattaggtttcttgagaaagggatggtattgctgacatacatacatacatacatacatatacatatacatatacatacatatatacacacacagatatatatgtatttcttttggaattccagaagactctatctgtcagaacaggctgcagtaacaagcagttgtcccccagatctcggttgttttaagcaataagaatgtatttcttgctcacacacatgatcattccaggttggctgaggcttccctccatgtcattgtccatgctttgggacctagactcttagagcagtaaacacctggacctgtgcggatcacagtgacagaagcgaaagcatggcgaatgtgtgttggttcttaaaacttccatcccagaagtggcacacatcacttgtgctcatgttttggtagccaaagaagtcacatggttaaggctgatgttggggatgcgaggaagcacattccttccacaggatggggccctgagcattggtgagctgtaagcaatgcgttctaccacagggattgtttgaggagtccttgattctagtccctgagatctggactcctaggcattacaggtatcatgagatggacaattaaagcttctagacctgttgaaattcacctggtgaccattctcacttaaaacaacaataagaaaatatttttggatagaaaagtaaatcaggccaaatcctaccatgagattctatggttaagctcaacaactgattattttgtgtgtgtgtgtgtgtgtgtgtgtgtgtgtgtgtgtatttttctctctctcaggtctatgcagatagccttttctcttacaccaatttgaggtattcatacccatatatcttctattactaaatacagtaattcaatggtaaaaatgacataagtacatcacagactatatggaaaaaagaaaaaacaatttcagtcatctaaaactgttactattagcattttggtgtgtttcctgttaatttttttagtcaatgtattggttgtatttttgataaaattgtgtgtattggagttttaaaatatcagttaattgcaatgtatctctcctcttctcccctcttcatgatccttcttcctttcttttagcacgtgattgttctcttctgctggcttcaaaaataccatacttagtattcccatttttctggccattctctctcaggttttgttgctgtctcctgatcttctacctgcttctctcaatgatgcaattccccaaagatcagtccaaggctcccttcttttcttactctatcctctcatctgagagtagctcatctacatccatggcttcacttgccttctgcatcccagtgattccagatctatatctctagaggtatcacatccccaggcataccatgagcacccatcactgtggccagtccaggagacctggagaacacatggcagggtcccaaagcctggctggccgagggatgagactgactctccagccccatggatgcacacatgttctctcgtccatgtgtctaactcccagtgggaaagtactcattcttcaggggttgagggaacctcttcagtttagtattgtgcacatatatggtaaaggaagactttcacatatggctggaacctcacattgactcaataaaatgagtcaggcagatagtaacatcctccactgacaagaaactaaagatcagggaggcaaagtgggctgcccaaggtcacagggctagctggtgactgcaaagtggaaattagaactcagctcttccgacctccagaccaaggtcattttttcattcaacgattattcactagaacctctttgtgctaggcacagtgttaagctctggggacagagcaattaacaagatagatgcagtccttgaccttattctagttggagagatagataacaaatggcaaaataaaaataagtaggctataatgtcacagtaataagtgcaccttgacctgcctgtacttacctactgattaatgctgctaatttattttccttggcaaagatgccctctcctccatttcttcctctagaaattgctcgttcagccttctccaataagaaagagttacctttgccaagggaacttgaatttcagtgttgctttgtcaattaaattgtgaacaaatcaatggagccaatcgtttggaatgatataaatacaatcacaatttgcctactccattcaaagctgcccttcctggcctcctactcccttgatggggtaagggaacccctccagggttccatccaccaaagtctctgaggaagatagcttcaccaagctggatttggagaccaaccctaggaggaaggactttctttcacttttcatttaaatgtttctacctttccgtcaaaacaccaaggaacgaggacatgctcgagagagacacagtgattggaatatggccagcctgggtctgcactatggcctgtttgggcagatgcttccataacaaagccacagtgcccagggcacacacgacgtgagggaccttgggggttacatcaggggccaacccaataagttaacattggatatcagcatttgtctctgactgcctcttaagtccctaagatgtgtcaggcactaagccaggtatagatgagtaggaaataattaagtgaatgcagaaggcatgacagagacaatgacataaatctgcattgggcccagagagaggctgtgagttctgtctggggcgagggtgcggggtactcaggaaggaatgaatcgaggagttgacttgaactgcatctttaacagcaggaggtgatcagtttgtagctgggaatcgggtagggtgtcaaggccactgtagacagagcaatgctagaaaaagagtcaaggaaggagtggtgtgtacttggggacagatggagtgtgaggtgcagggcgatgtggagatggaaggggagggagggctgctgtgagaaatgtggctggtggggtcagcacagaccacaccagaaggtcttcccagcactactgggagtttggacttcatccggaggcaatgcggaaccaccgaagggattgaagccaaggagtagcatgatcacatttgcacttaatgaggcttgctctgatggtggtttggcctgaagattaacatattgaataagagaaggaagcattcagcacatttttgttaaaggtcaatgtgatttgtttaaccaagcttgcacgaggaacacattgggtactctagcatgctgttattattgcattttattttattcggggcggtggggaggagtgaagggggaagtagaaagagaggcattccaggcatgactggagtaaagaaaaggaacatgttttgtttctttgagactgtaaccagcctttgtgctgcagctatatttgtggaaaagattgggggccgaggtatagtgtaggctaggagcaagagtcaaaggttatgctcagggatttatcacacacagcaggtttccaaaacaccgtagtgctgataccccagactccatccactgaggtcctgccaggagatccctctttgtccactccctctccaagatgcaacagtcatcagaggacataggcagcttctgctctcctgacattttcactccccactgtgttccttctgcaaatcttgttaatacttatactctaccttttgccctttttatatcctcacacagcagaacttggaaagacccagagtggagagtgtgagttttagactcacatcgcagttggagtgctgactttgctgctcactctccgtgtgtccttggacccacaggtaaccctctgagcctcagtttctacatttgcaataagcagatggttggagtactttgctcacggggttgtttgaggaataaacaggatcatgcttttcaagcacctagcataaggtgtggtccaggtttgtcacatcctcctaccctgccctggaataactactgctcctctcctcaaggactccctggcttccccagctgggccagtgccctccttttttgctgtatttactgaattagcttgtcaatcattatttgcctatttgactgtccctgctaagctgtgagccttcaggggaagggtttgcatcttgtatctctaagcccccaaatgccagcatgagtccaccacatactgggtgtttagtaaacactgctcgaatgaacaaatgaaatggtttctgctcagcagctctacctgctggcagtgttgggcaaaagcaagggaggaagagacgacatcatttatcagatgaggggaagcatctctgaggctccagtcagcatccttagcttaaatacatgctgcctaccatctcccccctatgtctcacaccctaagacatcagggtgagattgcctgccctgtttccatctccatatgctattaccatgtttccataccaaagactcctctaccttcatatttacattgctgagtcagtgcgcatttaacgtgtaatgtttgttttcatgactcatcatgctgcctcagaggctgccattaaatcagtgtctatcttttaggtattgggatttgaaagccactggctaactttctgcatcttcttttctctctgttgaagcttgctttgtatgtttgataggacagaagcagagggacccaagaaaagaacatgagtaaaacagaagttttcagccctaatgtcaaggcacactggggtgttttcagggctaactaggccaggaactagcttttagtcacaaactatcttgtccttgcagcatccagcagaaaaccattgtttggttcttgtcagcgttatcgtctgggcattatagacagaaagtagactgaggaccaatataccagaagggagattctcctctctaaacttccaaggctctattcatgagtaaggatggcaaagatctagaggaggtcagagttgtttgtgaacaaagatgcaaatttggggtgaagctcagaggccagtgggggagtgttcatgcatgtctctgcttgctttaaggatgtttattggtggaagtgaggacagatgttcaaataaagtttcatgaatagttttgcagagaggtttctctacctatcccctctttctctctctctctctctcagctctctctctctctcctctctctctctctcatatctctatcacctacttacctgtcatatgagaaaatagcttataaagggcaaatcctagatgtcaagtcaagagtcttaattcaagtctgagttctagtggtagctttgccagcaactcattcttccttcatggaaaagaatgtaacctcttacttgaggataccaaacagtcctggaaaattgcatcttcaggtattaaacattctatggatccgaaaccatctttcaacataagcaagcttgttagccaaatttatcttaggtaggtcaaatttttatatgagagtgttgtaattttgtatgtgttggctgtatctttatagtaaaggaggaccccttggatcttgaataatcaataagtgtagaatatatgtgtgtattttatcacccaattttattatttcaaatgactgcagaagttgacagctgaacctttggttttttgacatgttcttgatgaacctgtgatttatcttatactgagttcttagtcgtggttacaactcccaagctgactttttctttttgtaggagacgtacactatgataaaatgcctaggaccacttgggggagtcgggggaaactttccctcagtctgaacttttttttttcagtctgcatttaacaggcagcctctgttaaatgcattgtgcttactcatgtggaccactgatgagatttaatattgcccggcttcctgcttatgaagttcccatttgaagagaactattccaatgagaacaaggcacggtagtttcagagatcaatactggacttgttcctgatcaatatggaactatttggcaattttctcatatagaatgacatttcctcttgtaatctgaggcaaattcaactgaaatgaaaaaaggcaattactaaagaatgaagtaatatgatattttgttttacacaaacaataaatgataaaagggacctctgagaattggattcgtggaggtaagctgctcctgttctgttccttgctgacgtgagtaactacttagattgcaacatggaaagtggtgtgctgcgttttgcattctgtgaaagcatttccaaagccgttcctttgaaatgaaagtacaagttcaattaagcatagagaaaggcaccaggagcaatatgcttaaactccttggtgatatttcgtcacatttaacaccacgtccctctgaggagcggcgcataaaacacttcccaaagaactgagaagtataaggcagttccaagttgatctgtccttgcctacacatgcatcttttagctgaatagaagatctgggggttgggggaagtaaagcaaagttataaacaggtaagactgaaaaagatgctttaaagggcttgtgccacgtgtcaaagcgctgaatctgaaagctctcctccagatgccttcagtggtgtggttttatttccttagaggaaatacattaggacaatagccatatctttttttttccttattttttatttgagatggagtcttgctctgtcgcccaggctggagtgcagtggcatgatcttggctcactgtaacctccgcctcccaagtttcagtgattgtcctgcctcagcctcccgagtagctgggattataggtgcccaccaccatgcccagctaatttttgtatttttggtacagacagggtttcaccatggtggccaggctcgtcttgaactcctgacttcaggtgatctgcccatctcagcctcccaaagtgctgggattataagtgtgagtcaacacgcccagccaccatacctttttaaatttgaaatttgtgatcgtttggattcttattggactaaatgaatgggggcatgcgacactgaaggagaatgaagctaccaaaataatactgtcctaagatgttagaggaaagtgttttatatgcagtgttctaataactgttccctcttacccacttaagaagcctctttgcacttcattggtcactagtttagccacttgaaaacagcataaaatctctttttaaaaaataatgctggcttaatgaaattgggtagataataaaataagaatactactttttatttaattgggattctgttaattaatgccaattaattaacacaagaaaaatggagggatattagccttattccaatacactacgttaaaaaattaaaatacttcaagtaaattaccaatatctcctccagaaaatccattcggaaaatctatttttcaatgtcatgattttagtcttaacccccagtctgttgaaggggaatttgactttaataaaatgggttttctttagaagactttctaaattcagcccgaatttagttcaggctagtttttttcattgtcagtcccagttagagtgttttataagtttcactcagacatatgaaatctaagcttgcaaggaaagtaaagtagtagaatctcattaaatcatcaccatccactgcatggattcaagcacaggagcggtatttcatttaaaacaagcaaattctgttgactctgtgtcctgtattgcatttaccttcaacataatttttatttggcatcatagcaacctgcctcctcccctgagggaagctggatttgatagccaggtaccttaagacaacttagaaatacacgttcattttacacctagtttataccactcattgttcaggcatttgactcattaccttgtttgattctcatgccaaccatctcaacgtcagcattaatatcttcctcttacagatcggggaggtgtttagaagcttgcttaaagtcaggcaacaaaaggaagtggtagagccaggataggagcccagatctctcttcactagaacacactgcctcccatgggtgtggtgcctttaccagcatggcatttagcctccaaaattcccaatcctcttggcgagattctccctctttcctccttgtatgaatttcctggcattgattttttttgtaactggctcaaaagaatgattttgcacagttccccccctttttttttttcctggtcattcattctgtgcccaatcctacaaaccgggcaaatggactgtgtctcttccagctgccatgttgtgatttcaccccgctgcctccatgtgtgcagcagctccctgcaccacctcagtttgctgatgaggcagccacacgggagcctcttccagggtgggattttaaagatatctttagaagtgattttcaatcctaagtcatggagatttgagttgctctttcaaaagtgaggacatgtcccgcctctcttctctatttattcttactctcaggatttcaccaacgtttaaacgccatctggatgccaacgtcttccacatttatatcttcagttctccctcctgaaatccagactcatatatccaactgcctactccacacctcttcttgggtaccttataaacatctcaagctgaacatgttcaaaatttctgatttccttcccacccacggatacgcttcatccacagtctccccatctcagtggatgaaaatgtcttctttccagttgctcaggctaaaagtcttacagtcatccctcactcccctctttctctcacataaaacatcagatatattatcagatatatcagtacatttcttggcttttttttttttttttttgacagaatcttgctttgttgcccaggctggagtgcaatggtacgatctcagctcactgccacctccgcctcccgggttcaagtgattctcctgcctcagcctcccaagtagctggaattacaggcgcgcgccacaatcccagctaatttttgtatttttagtggagatggggtctcaccatgttggtcaggctggtctcgaactcctgacctcgtgatccacctgcctcggcctcccaaagtgctgggattacaggtgtgagccactgtgcccggcctcttggctttttctttaaaatatatccaattatttctcaccatctccctgccaatccccatcagcccggtcatggtcagtgccatcgtctcattatttgggttgctgcaatcctcttctattgtggactctgccccttgtagtctattctcaaccaagcaatgaggcgatccttttgtcaacagatgatgtcactctgcttaaattcctagattgactttttgttacaatgaccttcaaggggcagattttcagaagactgaccccctctagaattaatctctgtgccttctctggtgactatatatgtcagtaatggcaatgtcactgtgtccctctgaatgactgatttccactggaggtaccatgttcagggccaggcaggagttggagagagcttaggtcaggatgtacttgaactgccaaagttcccatcagttctgtggttagtatatgtccctttcaagtggaggcacatgcaaatagcaaaaagatgcttcttcaaactgaaccaaagttggaattaagagaaaaacatgctgacaagtttcatggaatgtgaaaacatcttcactgcaattagttttaagaccctggagctaagctttccttcctccttagggagaaagcatgataggaaggaaaagcagaggaaacagtacccaggaagacctgtatttggatacttgctcttctactatggaagaatatttttcaggaaatgttcacttcttcctcatcttcatctccttggcaggattttcatgttgagcttggccatatggcttgctttggcttgtggaagtggacagagtgagtgtgtgagtttcatgactaggccttaagtcacatcacttatttcttccctctaccatgagaactacttgccctggatatcatcttgatcctagaacaatgagagtcacgtggagctgagctgcttcagctcacttgcagacctgtagctggaagcagagccacccctaccaacccaaggagggagcaataagaaatcaatgcttatcattgaatgcttgtttattacgcagaagttgctgactgatacagccattaaatgtgtgtcattggtcaaatgacttcacctcttgaagccttgatttttcccatctgtaaactggggatggcaatcataccgctctgaaggacttcgtgagcactaggtaaggagcctgtatgtaaagcatagaccttggtgtgtggaaagtgctcagtaagcatcatctccatattcctggggctcagcacgttgcagagtggatactgcatctaaatgagcagagcaaattgaagctatgctggggtgcagttctgggtagcaacagtagaatgggcaggggtggaggttaggtgtccctcagtagcatggtagaaatggtggggtggggggttgatttctgtctctcgaacatttagaaggacagaagcaggataccctgatagggccccctgagttttcttcatcttaacctgaatttatgggccagtgctggcctaacctgctgcctgttggaaagcctcgggagggacttccagtcttatgtttcccacccactggctgtgttctagtgaatgactcctactccagactcccctgcctgccactgggctaaccttctggctgccctagggacaaaagagagctgtggttttctgctgcgcaaatcaattcatttctgccgcagtgtcctgggcaaagcagtgtcagggtcattctcatgaatcggccatcattattcctgcagtgctgctcccttcaggtatgtgacaaaggtcactacagaggacacctcaattactccctgctgaattataggagcacaaaattcctgttattagggggcctaaatcagctatctttccccatgcaggccaggatctctttatcttgctttggctcccctttcttttccctgggccctgagaggtgtagagtatgggggtcagaaggagagggtgctcctgctgtcttctatttgcatttctaggaatgtgtcttcagaggtgaaaagggtgtttaaatgtctgcctgccttctgcataaacaccttaacatggctcaagatccggctccagaacatctttcttgccactccctctgccccgtcacagctcctgaaagaggccattcatccttctattcacccaggccatcaccaatgcttattgggcgtgcctcgtcttaggcactgagacgaagagctgatgaagacagagttcctccctctgaactcttcaccggccttcagtgctctccaggttttgtgcatgtggctccccacacttggaatgcttttccttccctccctccctttcttcctttcctcccttccatctgtcttttccttcttccctgcctccccttcctctccctcccctctcttgctcctcccttggtggcacaagccacatcacttaatattaatcagaccagtgctgggggatgggtggtggggtggggaggaaagtccctctaatgattgactctgcaactggtaatctgttagactgtgtgttggggcttaatgtgtgatttcatgcattttcacggtctctaaattgcaaatccaagattatttgaaaacattttatttaattttcatgcttttttcatcaaaaaagttaaaagaataataatcttttatgggcagttataaatgtgctatttacacacaagacagaaatatctcccttagctgagcaatctaagtgtgtgcttagagaggactccataagaatactaatgagaaaaggcagaatatgcttggagacaacctaattcattcttctgggcaatgtctctctaggtggagcgggattctccaggttcattcctcagccctaccagtctcccagcctctgcagatgggagggacttggcagtgagcacgtggtagttgtagggctgctgtctgggccatctttacatccctggagcttcgcttggtgcctgtcatggggcaggcatgcaggaaatgtttgtcgaataagtgagtaaacggctgagtgaagcattctccatactctcccttggcagtccaatgtgagagctgtacacattcatttttttttcttcacatcaccattggagagagaagcagcagacacagctgagctcctggcttggtgaagggcatgccaaggggatgtgggtgcttggatgtttgccaactgtttttcacttttgtgagaatcattatttacctattgcttgattcagaatcccagacctagaaggactttagaaacttgaagttcaacttttttactttataagatgaatgacagagtcaaagtgaggaaactccttgatgaaggacaaagccaggacttgaatcccagtatcctactcgctcctaattaggtaaagacaatcttttttcctcatattatttctttcatctatgggtgtgtgctgtctcacccaacttttcccaaatcctgcaccttctgggattgctggagatgacagcagcatctttttccttcctccttcaactttgcactgttctctcttttctgcataatgagtctggggataaaacactctggaaacccaaggaaactggacagagtcctctacatccatgggccacacatgtggctgaagagagatgctatcctgtctctgcctggaaaggagacccagccacacacagagaaatggtctagccgagggcttctgtaaatgttgcgattggatccatagtacctgatgagggctttctcaatcccgtaattggcaaagccccaactgtgaccagctgacacggtggagcgtgtcagccagcagagtcccctggctcattaccaatctatgggataacgatgaccaccatagtcataatcattatcaccttaggcatggatgacaaaggcaccctagggacttctgcttgaaatgagctgcttcttagccaaaccctaatctccagagtgactttctacagaactgcaggatcatgaaactgaaaagggcccatggagatcatcagttctggcttcccgccttcaggcaggtctaacctttatagaatagttgctgtggaggaaattgaaccaaacttacttttatatgttattcttgtgatagtatctctgttgagcattcgattaagaaatgggtttgatgaatcagaaacctggaggagaaaagaaaatattaatgactgggcatcactcttgcaggacaaacatctccccgtgacattcacttattcattcatagttactgagtatctaccatgagccaaacacaatgacagctgcaaattcagagagcaaagccagagtccctattctcaaggacagcccagtctagagaggaagacaggtaagtgaacaaactgttctcatatagtgtgaagagtgctatgattgagtcattggtgtaatgatgttggaggaagaccagccaccacctgagaatctaagtcatgagtctgagaggatgggtagaagttaacaaagcgttctggtgatagagtgtgaaaagggatgaaaggcaaggaaaagcatttcatacagaaaatctttacatacacggacatggggaagtgagaaccaggcatgctcatgcaaagacttcagtgtacttggagctgagggtatggggaaggataggaagtgagcctagaaagattggcaggggccagatcatgtcaggcttttaagcaaggtagggactgacatgttaggaaggggaaattcatctacgtagagggtgagacataaagagtacccagaatagaggtataaggaaatggaaaaaaaaaaaaactgaaaagtatcactgctcattattgcatgaattgagtatatcataagccatgtaattcaatcaaccaaccatccatccatccagccagccagtcagccagccagccagccagccacccacccaacaaataaatatttgcagagggtctattatgggccaaacattgtaccagatgttcagggatcagttcccattttatgcctatgcccttatagcttcaaattcctctgttgggagaagaaaccaggtttccaggggcttcagcagggaaccatcattgatgagactgtgatgtggccctacataagaaaagggttttcttaaaaacacctgtttactcagccttttctggggtaccattgttcatcctagtcatttctctcctaccttgcttagctctgctctgtaatttatgtctcagtggctaatcggatgttgtgacacatcaacattttaaatctgatttatctgagggttggaaaaattgcagcagatgattattattattagataagcaacaggtaattttagcttggagaaagcacagactgtttattttccctccatctgtctccctttttgcggtttcctggctgtgttgtggtgagacacacaccaaagggagcttggtgagtgacaatgcccagtggaggtaaaagtccatccctaaatagaaaaagtcccaaattgaatactgctgctcccctcagtgctatattcaacatctactttgacatcctcttcagccatttaaaagatagcttgaagcctgctcctggtgctgatgcaccccatgaaagaaagatggctaggaatatattgtcgtggcaggtaaggaatctgttatgtaccttacttcctgggtgccttgagctcctggtacctggtgagtctggtcagcccttgcgttgggagcagaccattttgagctgattaaaaataattgaaaaatttccaaagtgcacacagatgatttgtgggctctagtgtgttggctgcgtgggtgagaggataaaatatgtacttggtataagtgagcttaagtgggaagttaatggtgtgtgattgagcagcaattacagccaaatctcagttccctgtggtcacagcaagggtgggggatttgtggaggacagagataaataaaactcatagataagcaagtatctccttttagagagtaactccagcttttctacggctcagcttttagccagggtgataactctaggactaaactaccaggatgtggggcttgtcatatcccactcctgcccaccctgctgggaagggaaggcagagagttcagaaggaggggaggacaactacaagaggctgtgcacccttagggaccaagagctttgttcatcttacttctggataccagtgcctagcagagggctggcctgtagtacctcatgctccatcagagttttgagatgagtgaatggtcagtcacagcttaaataactcatggtggagttgattttctgggagttgattatatggagggaagacagaaatgttgtggcttattttgagatctagcaagaaagtttcaggtctgctcagggaaagaatggcttcatccctaggagctaaactgacctgagaagatgcaggagctagttattatcccttcactgacctcagggtctacagcctaagtttctttcaacagcctgtgggcaagcaactaggacttgcaaaccccagctgctagtcaccagctcggtaggaatgaacatttctgtaggagcttgtgaaacacaccagtaatttgttgttggcttcccagtgtatccgtcactctgtcagctgtcatgtgcctgtgcctccagaatgacagtcactgactcaagttttcagacacatgaggtaaagtcaggaccaaggccgagacactctccaaaggacaggaattgctggggcaggcaggatttgtgctgggaaagtcatagggggaagtgagctcctggacacacatgacaatattgtgacctatctacggcttcacagtgagtgcagcctaggttgaatgtacaaattggttatcaatgccataatcagggcttgattaagagatacaggaatttgccctgtgcttatgagtagcatggggttgtggggagtgtgggaagaatgttttaaaatgtcatgtactcccttcttgccctcacttgctctctcccagctctattggagaggcatagaatgagtaagccattctttcatgagtattaaagtcagggaagacttggatcctctcctggctgggctgttataagcgacatgaacttgggtgaaatcccaaaggttctctgaataattttactcatctgtaagatacaacacgaatgttcaacctctgagtttattactaaacaacaaaatagatgtaaaatacatatcatagtgtctggcattcagaaatctactgtttattattccagggtttgtgatgatgccaggagataccattagaatctgtgctgggaccagtttcctttgagatgtcatgtcaagtatcacaaaggcatgaaagcctaaaaatatgcttccctggccaaatgtcccttcctctctttgttaatgacaaaccagaggaggttgaggttagtggccagggatagcaacatgccatggatgccccatccagcccctgcccagtgcataggtctgccctgatctgaccaaggggagggtgaggaagttaggagggggcatggcatggatgaccagggagggtgaagtgcctatggcacggggtaattcttttgtgggggcggggagagggatcagtgccccaggtgcccattcttctgagtaataatgatgtcatcatgacagccctgttaaaattccctggtggcagttttgatctattgatcatctccatcagattcccaattccgattggggcactttctctaatgatctggccaaaacatccccaggggctagcatggtgactgctaatgtttggaactgccacacattgcttttttttaatttttatttttctaattagaaaagcaatttctttttttattaaaaaatttgcatacctgcttctctctacatctgctaaaatgttaaaggtaattagtatttttttttaaacaaattagaatgtgattggttggagattttatgttgtcgttgttgactgttagggagatgtggagtttcctcaaaatgtcataaagtcagtgtgggtaatcttattaccagggaggcttatgaaggaacgggagagcgagagagaaagatgatgctcagagcaattgtgaggaagctggaaggagctatttagtgcagtgcctggaggggagagacatctcacttcttcctatgtttacaaggggcagctgaatggtgaacaggactttaatcctgtggggcattagtgagccacccacccttctagtattatatccttctgatttcactgcattaggtgggtcctaaagcctgtccctggatctagccccctttttctttctaggacagaagctgcttgaatcctcaggcccagatgctctgaaatggagattatcatttttgcatctcactgcagggggcctcatttttcataaatctcatgtatataaaaggcaccatcccatagttttcttaggcatggatagcaccccttttaatatttctaactccaacagagaccgtaaattggtattctgattgaggtggggatggtgagaagaatgaaggaatgcaagagacttacttttataaatatagaaactaccaccaatccatttggactctttgcagcttctgtgacattcgtatatagctcatggttatagtggatgagctgcacctggcaggagggaaaaacaagaatcagaacaataatccaacattaaaaggtatgaggcatagcacctgcccctacataagggtgaactgcaaagtatattgaggaacaatttggaagacaattttaattgaagggatttcagagggatgtgtgtgcatatgtgtgtaaaatgcatgtacacgcacacaaaaatacccatacatatttgcaaatgttttctggtaacaagcatgcttttcataagctcagagcccatctggctctggctccatcccaggacatttcccctaaagcgtgtgtaaagtgaattttccttattaggaacggaactgccctgtaggggtggatgttgtgtccctgctgcaccaccaacagctgccactggcagccagtaaatcttccttgcagcctcggagcaaacagggagctgttaggtcctgagtcagccatgactgggatgaaactggccagcctgcaagatgcagtagtagctgatggatcaggcttctgatgcaccagcctgtcccggtcatctggttgtgtaggactttatttcctcctcattcaataaggatcagtccacctgttgagcctttttcctgttacttaatttttttaaattcatttttaaaaatcgtgtataaacatacatatatgttcaaacagatgctccagcaatttttagccacatgatcaagttaccccacatcactgggatcaattgtttcctctgaaaaatggatatgatgatctttccttaaaattcatcatctcagggctgtgattttaaaacagttttttcttaacagtatggaagcctaattttttttttttttttaagttggagtctcgctctgtcacccaggctggagtgcagtggcgcgatttcagctcactgcaacctccgcctcccaggttcaagtgattgtcctgcctcagccttccaagtagctaggactacaggcgcatgtcaccacgccaggctaattttttgtatttttagtagagacggggtttcaccatgttacccaggatggtctccatctcctgacctcgtgatccacccgccttggcctcccaaagtgctgggattacaggtgtgagccactgcgcccggccagaagcataattttttaacaaattaaaatatagaagtaaaaaacgtgatgccccccccaccacctctttctaattctagtccatgctatacatacaactattaacagtttagtgtacatccttgtggttacttgttttgtgcttataagtcacacaaacacacatagcgtataaaaaataataaattccctagtccacagtaactgttaaaaaaacagaaagggatgattaataattatgattctgaacttgattttttaaaatttaaaagtagtttgtagctatctttctaagccaatgcatatagatctccccaagtcttccaaataactatagaattctcagttgcacaaacacccataacatatttaaccatcttctcgctggctttcgtgttgtttccatttttttgtctcttataaacaatgtcacagcaagcacatcatatatctttctgtaatggtgttagcattttccacaggctgatttgagaatccaataagatagtgcatgtagaagtgatttgtgactctgaaagtgtaagagagtactcattattgccaatatcttgaattgcattaaaaaaggtgaagttttagaagttgagaaatgtgatgatcaaaaaagatgcttttccttgaactttgagaaaaagaaaccatatctaacccagtggtttgctaccttcactgtgcatccagatcacctgggtgcttttaaagcccacctgtgcctgtctatgccttctcacattctgatttaattgatttgggatgatacttgtattcatcaaaagcttaccagctagagggaagttggacttcagaacaagtggaacataatcaatgaacattaatatcccatcaatgcctagtcagatggacagtaccttgaatctgagaatatcctgagcctcctgaggtgtagaggaacttctcatgaagagagcacatgttactgctgctcttgaaatatcctatttgcttattgctttttcacctatgagttttgccagtggagatggatgactctatagtagctactctgccatcagaaaggcaaccgcaggccaggcgttgctctgcctccgcaggacttttaatcccccctcccttgtacccccacacaaccaggactttctgcaggtggagaaatgttgccaggtggtggaagaaccagggactggggggttctcacacactcagcacacctcccttccagtgctgagtaagcttctaatgagaacaaaacacaccctgccatctgctaacttcttcccactgatacaggtgaccaacaaaactgccaggggatgtgccagtgcttccagacatgccttgaagttaaagcatgttctgaacagaggagggacatgaaaggcaatccagtggagtgatccttctgtccagcttgcaaggcagaaaaaggcaggaagaagtctcctgggccatgggctgcctctcagggtggggttcttttgggagccaggaactgtaagaaaggagctggcaagtacagggctgaggctgtgctttaagcttgagttaacacatttaaaactttgatctgaagtcatgcctcctctctgttccaaggtgagttggctaggattctgatatcaggagctttggtttctattagtagttgttgatggactgtctattgtgttaggttgaaccacatgaaattgatcttttgctttacaaaactggtgaatttatagttaatacattctagaaataaagctattttgaatatgagttttgagcattttctttctgacccccagtcagatgttaataagatgacagtgtgcgctctagggatcagcagcagccacagcatctaggagcttgttagaaatgcagaatcgggagccccatcccaggtctcctgaatcaagatctgcattttctcaaattcctagtgatttggatgcacgctaaagtttcagaagtgctgctatagcagatactgttggctggtgagcagagtcctgttttgtctggctgtttaccccttctccacttcaatttgggtgggttaaggagcacatgcatcacctatgttggaaaacaggctgagtccagatcataggacccctggaatgtcagcaatagaaaggctttgagcaggggaatgagataatcagcatggactgtaagagggtagattggagccaggagaaaatagaggtggaggttggggggtatttaatttcagatgatggttattaaggcagagatgtgctctataggcctttgcagtttacagaatgtgtatgtttgtgtgctgaagaggcaccaggagatttccccaggcaacagaacatctaggagcaacagaagagcacaggagacagcttgacagtcaccaggctttttgttctcagctgtaagaacacagtttgggcatcaaagataacctgggacctgtatcagttcatgcatgaacagcaggtcttaaccatgaaaaagtgctgcttcctttctactgccttccaggtctttgttggtggtgatcacagttcctgcagctgttgcctttgctcttccctagccaggcacaataatgctaacccaatacccactaaccactcacaatatgcatgggtccaggtgggtctggagaaaagcagggttcactgcttctcctaccatgactttgggcttggggagcagcaatgtgcaaaccacatcctgctagggacagagtatcagattggcagatgggttctgaaagtgatgcctgtggatggatttctttttgccatgtataggtaacacttttaaatctcaaccatataaagtctgaattttgaataatttagatgggccctaagctataccttaactgagccccaactttaaggcttatgcagagtaatcacagtgtctgatgtgaaacagatgatcaataagtgattgttcaactgtctgagcaagtgcatgatttgactaagactgcagggacaatgagagcaaactcttcgggggctaatgatgacatgctaattaaacaccaagttcaagttcaagaatttaagctattcattaaagagatgccttgagggcttctgctagtttagttggcattaccatgtgaaagggttaaacctggattcctggaaattatttaataatcttgattttttaaattagttttaggcgagtatcctcctagagaagcttcctggaaatgcaagactgagaaatggcaggcagtcttccagggagaatactaccagtcttgtcatgatgctcccacatggctggtgccatgatgcagtgcattctctatatctaagaagtcctccatgatctgatgtgacttgacttctcatttcagaaaggccacctcacctcaatcctttacatgggcctggaattcatttgttcaaaaaatctttgagggccaactatgtgctgaggtcaattggaataagactgagaaggtctttgtcctcctagagatagtttcagatggtggcaaagatagctttgaaggaaacaaaacaagattttgacttacttacagattgaaaggtagtagtggaaagaatgggggcgaggatgcagaagtgggggcaacattctgtagtatggttggtgaaaagtctttgggtaggctaacatttgagctgaatcctgatgaccaggagccaggtatgggaagatcagagggaagcatatcacttgtagagaacacggccaatgcaaagagcctgagatagggacaagcggctaggaatggctgggaaaggatgaaggtggctcaagatgggaccagttcatgcaaggctttgtagaccatggtgaggagctttgattttattccaaacacaataggaagtcacaggtgttaaataagaaaccaattgatctgatgtgcatttttgaaagatctctctggtgtggaggagggcaaagtggggactgaggaagccttgcctacccttctttacctcatagttcagctgggattgtgcccaattcctgcgactatttgagttcacattcaagcacatgctattttgcaactattctctttgtgtcttaccttctccaggacaccttccatgaaacactgtctctgaacaccaagtgcagctcccttctgctctcatgatgctctcacccaggaggcaaatttgtgatggttaattttatatggcaacttgactgggcaaagggatgcccagacagcaggaaaaacattatttctgggtgtgcctgtgagggtgcttctagaagatattagcatttgaatcagtaggctgagtaaagaagatctggccttatcagcgagggtgggcaacatccaatctattgcaggtatgaatagaataaaaaggtggaggattctctcttccttcagctggggcatccctctttctttgcccctggacatcagagctcctggttcttgggccttcagattttagactctgggacttacactagcgaccacctctctccctgtggtttgggattggggattacaccatcagcacctcctggttctccagcttgcagactgcacattgtgggacttcttggcttccataattgtgagccaattcccacaataaatctcctcttatatatctatgtatatagcctactgattctgtttgtctggagaaccctgactaatcaaaattcaaaatactttgcaaccaaaatgggatgggtaccgggtgatcagaacagatgtaaaccatagacgcccagtacagtcacatgagtgctgaatatcattgttaaagttagtcatcatcaccactttggatgatcattaccaacatttgtcgaacacctctttgtgtgagagacgatgccagcagaaacaactcatttaattcttgaaaacttctatgagttagtgccattatttccatttgagtcatggggacaccaagcctctgagagatagtggcagaggtgggattgtgcccagttcctgtgactatttgagttcatactcaagcacatgctattttgaaactattctctttgagtctgtgtctacttttgggtaaacatctcaagggcatggatatccatcatcacatccctggtgatgggatttggctcagaggagatgttggcaagcatttgctgaatgaataccaattctgcatctcatagaatcttagaaggggtcttagagaaaatcaaggtcttagttctcagcccatgacttttaaaaatgaagaaaatgaggatcaaagaggagctatgtcttgcccatgattatacagtcattcatagatccaatcattcaacatgtgtttattgaacaactcctaagtaagggagggtgatatgacgagaaattgtattggaaggcaggagaagaccatggagagcttggcaggccaaggtagggggtcttgattccatcctaagggtaacgaagaatttcacttatgtcctagaattttcttaggaccagaggcaaagtttctcctatgcacttaattgaagtggaagcctgaaaaccattggcctttggtgaccggtaactcagctttcaagctaacagacaagtactcctctgtgttaaataagcagacctgctgcaagaggcttccaagttgacacaagccacacttgtcataggttaagctgggagcagcttcagttgcacaggtctcagagttttcattttgtggtagcaaggtgatgcactagtgcatgccgggggctgctcactcacccctcatgcctcaggagggcaacaggctgtgttctcagaccttagatcacctttctcagcgtgatgctccattagcagaagcccttttgtgagcgcaaaagagcagccttggaacagaagaccacacgtggcgttcacagtgacaatgctatcaccttacccctgcttaaacacctcagtggcttccccttgcctgtaacataaagatgcacatctggggcccctggcttttctaaccatgtgtccttgttttctgtgctctgctcagtgtctttctttcagcctcccttatatactgggcttcctcctttcctagaacacatgcttattctgtttcttatgcttcccttcccttaaacagagaagggagggaataaacttccctcccttcactgtttgactcctacttatgaactcctttgtatctcagctcaagggtcacctgttgagggagatccccatgatccactgtcatggcactctgtacttttcaaaatacatatcacagttttagcttgacattcgttgtgtgactgatgaatgctcacctctttccctagactgactttaggcttcatccaggcatgggctctatcttattggcccctgtgacatctcctatacctggtacatattaactgtatcaaggcagaaataaataattgttaatgaatgaagcaatgcaggctgtctattgtacaatgaagtgtgatgtcccaagggacagagagaacaaggcgcttggctgaactggttaaagaacagtctggaattccaaaggttatctctaatgggaaccaagacactgagtatcacattgggctgcgtgggttgcaaagcctggtttcacccttgggtccccttacatgagcaagtctctcatctataagagggatagtaataattcataactaatactcatagcactgtgtgatgattctataaaaccgaatataaaaaagcacttagcccaaggcctggcatgcagtaaccattccatagtaagctactattgttgttgttatgcaatatttattatgcaagcaatagataatacagccttcagcttctgcagaaataggggttaggtatgtgcaggtctcctttgtggatccgacattgagtctgttctcccaaggaaacttgaggaaggtgtcacctattggggagcacccactgtgttccagacactgaatgaggcgagaacttttaaagagaaatgcattccgaatggctcatactgtaattcaggggtcagcagactttttcctgtaaagattcagatagtaaatatatttttctatgccaactgtatagtacctgtcacaactactcaattctgcttttataatatgaaagcagtcatggacaaaatataaaagaatgggcgtggctgggttccagtaaagctacagaaacacagcgtaggctagatttggtctgtgactgtagttttctgaccgctgctagtttaaatttgggagatgaataaagaacttccagtcatatattttccagtaagtgttctatacagataggaaaatacatgttgagagaacctaagcattaagctctccctttcctttaaatgatgatgattactattgttacctttatatagtcctttaaacttttcaaggcatattcaactcaaatgagctgaattctagtcaacgtataggtcccaaatgcccaccctatgccagatcccagaagtccagagatgaatgctgtatattccatagcctaaaacagctcacccatattaccacatttgttcctaaaataaataggtgaagtgaagacattaaggcacagagaggttaagcacctcttctgaggtcacacagacaaaaagtgacagtgactattcatttcacattagcatatgcaaatagtttctttctacaggaaagtaaagagaaaaggaaaggtgttctgtatttgaggggagatcacatttcagcagcttttgctggaacaactataagctagaacttatttatagaaagtcattaacaagtttgtcttcatgcataagagcacacacagtctgcagagaagaacacagtttgatgtttaccagccaccacattctcaccctaaggtttggtaactatcatgggtctgtccggtgatgagattttctgcattgtaggctatggaatgcaattatggctaaaaataaaaataattttccatagtttcattgacagaagatccccaaatgtggtctggctatcataccaacctagaaaaccagcatggaatgtaattattttcccccaaaagataacacaacttggattttaaagcatgtttttcatcaagttgtatgggagtttgcacaaatgtagagtgatatatttgggtgcaggatcatgctggaaaatgcaagaccttgagcctagtcagatacctcttctgtccaagtaatgtggggctacttatcccctctgattatttctttatgcataatatagggatgcatctatctaagaattgtcatgagagtgaaacaagataatgacacagtctttcaggaacttggcagggtataagtaaacaagataaacagatgagataaaacacataaagaatcagggaagttccgtgatgctttttttttttcccggaacttggaatgcgtttcgagaccactttttctcgattccttccccaggccttcgcatccttcaacttcttataaaggagctgctgaaagccagagtgggatgagcctcctgcacgacgtctagatcctcccagaagtgacttgtaggcagtggctgccaccatccaagaatgagagatgaggtctgcaggtccttttgaaacttctgctgattttagttaagcctatttcttccccatgctcctgcaacctcaaactcatcccaacacagggcatggatgaggagagttaggctctggctccaagtcctgggtcttctggtcttctttgaacttcaatttcttcacaggcaaaactgtgatgacaacataaccactcaaataatcgtgctgattaaatgaaccaaaacatgtaaatgagctcaggtgtacatgggataaaggaggcttcaaatgcagtgcctggcacaaagtaagccctcattaaatgggagttgcagtgattattattagaaatgtctggctgctggggctctgataaagggagaggccctagaatgatgaagtgacgtgttaagttccatagataacaacaaagtcaggccattcacactttgggactgtatttcttgacagtccatatatcattcacatttgcatcttactttatcttattgtcagatgactaccaagaagattttgccagtcttttctttctgtagctcgtattcttgtattatgaaaatagatatactgaacatgtctcataccaaataccttttctcttttaggattgttgctatttctgtggaagagtttgtcccatgagaaccactgtactggtatgtgtagggcatttttgttaaatattaagtcattccagagcccacataaatagtattaataaaggctcgctttgttttaattattgtagagatttaatgttatgtagttcatttgagttaaggcaagaattatttttggtcatctcctacgcaaaaaaaagcgttggtctagatgggtttataagtatattccagcagatatttgaggggaaaataggccaatatcttttacgatcatatatgcaaaaagccaaaattaatactagctagtggaaaacagcattaaaaataatttattacaatcaagtagggctcatatcaggagttaagggtaaatcaatgctggagaaatcttccaatgtgatctagcacatcaattgaatgaagcagaaaaaaagggacatgaacatctcaatatggagtacctgtatttagatagagctaaccaaattaacatccattttagtggaattacttctcacttaaatggatgaagtatacaaaaaaaaaaaaaaaatagaatctaatgcttcaacctgatgcctgggatgtcttttgcctgaggtctgagctctggagtgaacaaggaagacagcttctagatgatcatgagacaattcaggccaaagcatgtctctgtgatgctgagaaaggctctgaaagcttcagcaatgtggtgtccagagggcaatgtgattgaatgatatttcgggagaccacaatgcgaagttttatcctcttatagttattcataaaagtttatagcttcactggtatagatataactaaattggagaggaatgtgatttttcaaatatccaggggcaatgactctcagtacctgcagtagatgcacaccaaggggttgacggagaagacttttctagctcacttcacagttagtccccatcctggaggaaggaaagactgaatcctcacacactgcttgccaaagccatcttattcactcagggttaattcagaagagtcactttaggtggctactgtcctaactgatatattcatggaaaattagacacataacatctattagataacagaggagggttttctctcctctcataaatgaagctgcgcagcgatttggataaactgttcacaaaactaggcttggttttgtacacattaattgcataaagtatgatacttaataagcagaaacacacactggtttatttcaaagccattaaacccgcagtggattgactgtaggggatgaatattagaaagagcacagggctgggagtcaaaggggctgagtttgaatgacagctctgtcattcagtaggtaggtgtgctcggtgagtcactgctcccttttagacctcagggtctttatctggaaaacatggagattttaaggacagggttttgtcattcttctaaaacactgatgggaaatataggatgttgcctcttgagtttccatcaaagtcaattaagttatagtcacatgttgcttaaaaaccaggatgcattctgagaaatgtgttattaggtgattttgtcattgtgtgaacatcatagagtgtacttatataaacccagatggtatatggtatagcctattgctcctaggctacaaatctgcacagcatgttaccgtactgaataccataggcaattgtattgcacacagtggtaagtatttgtgtatctaaacgtagaaaaggctcaatcaaaatacgatattgtagtcttaggggaccactgtcacataggcagcctgtcattgaaggaaatcttgttaggtggtatgtgactgtatgtagaattgaaaccaaatatttaaaccaaagtttcagtaggcagcatgtttatgcctggggttgcaaatggatgactatgggaccaggctgcttgtctcaacagaggagaaggctaggcaaaggccatggccaaaaaatatgaatgtgcagcttagtcccagggtctcctggcagccactttgtgactcctggtttcttcatttgatcgtgcttaggtcaaatcaaaccaaatccaaacaaaacaaaatatctcaaaccttcactcattgattcttccaacaaacccgtatgtgtttcccatgtgccaggcactgtgctgggcatgaggagatgaaaagagggaagaccttagaggcagtaggaggcacatatgcaagtgtcctgtagcatcatggaagaccatgtgtaagaggaagaggctggagcccagaagggaaggggaatgaggtaggctgacccaggagaaaaaggtaaggacagaccacattcatgcttggagaccctggtaagaatattgtctatcctcagaacagtggaaagtcatccaaagtttgaagatggagaagggggttgtacgtgcaggggtagggaatgttgatgacagcaggtttgtttctgacactcgattgaaaactctagagggaagtgaccctttactgtagcgccttttctcaatgtggtgtctgattcttccagaaatcacattaccaactgcctgccaactttcccctattcctgcccttccagagcctgcccaggttcttggtgagccaggtattcctaatcctggaatcatatcactcaaatttaataacctctctcatgtgccagtacttgacaagttaaaagtaatttgaatatctgagtattaatattttaactatacaaggcaccacaaattatttagtgattttttaaaataaaaaagcaaataagaaaatgatgtatcaattcagattgcagggaataggagatcccaacacaggcttctgaaaaattgggaaaagcacccaagaagattataaaagatgactaatgagcacaaaacaacttttggcaagcacaggaaagtattagcttattccaagaaacaagacacatttcatccaattattggaaaataaatggcaagaaaaaccaaataccaagaaagtacccacatttatgtggaaaagtataaaagcaatgattcaggaactaatttgaacaatccagggatagtcatattgattccagcccattgctgcaatttgaaatgaagccaaatgccagaggacaatgagatctgttttatgggctcttacatgccacataggagggagggagccacaggaatgcaccacattgaaaaaggaattgtgacttctgatgggagggcttttgggccaagttaaatctcagaatccagctctccccctgctccccagacagtgttgctagaggtcaatggacagtggggtctgagcaagtcttcattgtgtgtgattgccccttgcttgcagggcctttagaacctttgcaccactcccactaactgcttgcagtacttccatcatgatgtcaatcccaaatacctcctacccagtttaaaacagcccttgtggtatatatgtgtgtgtactgcccagatggagggctgtggctaggaaagtcagtttccctatccgtaaattggaagaatgattgatagctccttgtgctacatatttctgctgagcaagcaaaaaaaaaaaaaatgaccttgggttagaacatccttcctgctgcactctgtgtggtcattgaatgtcacttctgtgcaggatgcagctgattcttttctctcctagtggattttgttttacagagggatctttggtcctgtgactgaaaggtgagttgggggtgacagtggggaaaggagacagaaggagggagagccaaattactctcactgtactgcagggaagtccagatggtgcccttgtcctaagcttccaaaatatgctctgggagggaaacagagacagcattttgctgacagcacttgggaacaggcgtgtgggcactctatattaagacttcaatatccattccaagtgtatctgtgtgtatgtgagagcactgtggctttacttggaaaccaccggtcccaatctctctggggcagattccatttttcattctttcctccctatccttgtaacccaggcccaaccattcagcaaagggtctacccccaaataccatggctccctctggggcctctgtcttttgccagggcaaaggttgtttccagtagaactgggtcagctagagggaaaggtctttatcccttgggtagccggagtctgaggcattcccaagggcgagtgggtacagtgtggttcccatccacagagtggtggcatgcatgccatgccagctactgtaccagggaggggcgatttcaagaagagactcagtcttggcctcaagcatttctcagtccagagagagagagagaaacccagctcttgcaggcagagctttataaattacaatgcatcttcctgcccacttcctttctgaacccaaacaatagcccttctgtgaattaggccaggatgctttgaaactgtctttcagacaggaggagctgaggacccaaagtcactcggttgtttatcaacagatctagacttaaattcaggtctctgattctcaaacacagtctaatttcgatctgtagacttggtcaagctgctgttttgtccggtgtactgtcctgatattgagaggtgacaatgtgctagcaacccttgctcgctctcgggacctcctcggcctctgcatccactctggccacacttgaggagcccttcagcccgctgctgcactgtgggagcccctctctgggctggctgaggccagagccagctccctctgcttgtggggaggggtggagagagaggcgcaggtgtgaaccagggctgtgcctgcactcgtgggccagcgcgagttctgggtgggcgtgggctcagcgcgcccacacttggagcggccggccggcatcacaggccctgggcagtgaggggcttagcacctgggccagcagctgtggagggggcgccaggtcccccagcactgctggcctgcctgcaccaagctcgaattctcgctgggcctcagccacttccctgtggggcagggctggggacctgcagcttgccatgcccaagaccctgcaacctcatccccgccgtgggctcccgcatggccttgtggtgcccggtcccatcaactgcccaagggctgaggagtgcaggcgcgggaccagatggcagctctgccgggcggcccagtgtgggatccactaggcaaagccagctgggctcctgagtcgggtggggacttggagaacttttatgtctagctggaggattgtatatgtaccaatcagcactctgtgtctagcttggggtttgtggatgcaccaatcagtgctcagtgtctagctaatctagtggggacttggagaacttttgtgtccagctaaaggattgtaaatgcaccaatcagcactctgtcaaaacggaccaatcagcaggatgtgggtggggtcagataagggaatagaagcaggccgccccagccagcagtggcaaccctctcgggtccccttccacactgtggaagctttgttctttcgctcttcgtactaaatcttgctgctgctcactctttgggtccatgccacttttatgagctgtaacactcaccgcgaaggtctgcagcttcactcctgaagccagcgagaccatgaacccaccaggagggatgaacaactccagatgcaccacctttaagaactgtaacactcactgcaaaggcctgcagcttcactcctgaagccagtaagaccacgaacccaccagaaggaagaaactctggacaccccatctttgaaaactgtaacactcaccgtgagggtctgtggcttcattcttgaagtcagcaagaccaagaacccgccaattttggacacaatatggtttggctgtgtccccacccaaatcttatcttgaattttagctcccataattcccacatgtgggaggaacctggtgggagataattgaatcacagggtggtttcccccatactgttctcatggtagtgaataagtctcatgagttctgatggttttatcaggggaaacccctttcacttggttctcatgccagctgccatgtaagatgttccctttgctcttctttcatcttccaccatgattgtgaggctcccctagccacgtggaactgcgagtcaattaaacctcttttctttataaattacccagtctcagcagcatgaaaatggacccttgcctgaccttcaatttaaaagaattatagtagctaccatttaaggagagtttcccatgtgccagcagggtcctcaatgccctacagaggtcatctcattcagttcttacaacaggtgtacaggcagggattactgtccccatttaccagatggggaaactgaagtgggggaggtgaaataacttgcttgaattcactcagtcagtaaaaggcagagccacatgttagacctggtttgtgggctttctcaccaaggattgtggggagcttccctgattgattgggtccgcattccttttttttttttccccctggaatctctgggacaccaactcatgcgtgaatctggggaattaatcttctcttgttgggccctggctgaggggttcagtgatccctgagctccattccagctctttctctggatttatctgtagcatccatacttccccaagtttccaggtgcttgtctcttatatccacaatgagtaacaccaccactagtgaattctagtgaacattattgggctataatgtgagccagggctgtgttagcctgttctgatgcattatctcatttgatccttgcaaaaatcgacgtatgagaaccttatcacctccaatttagagttaaggaaactgagccttagagatgctaagtaatgtatccaggtcacacagtttttaatagaacaagagcttgtgtctgatgccaaaaacaaaatgttaagcactaagttatctggcctctaatagacggaagtgctctgggacttgggattgtcaatcagacttagggggtggctaaataaatgaacccctgtggaatgaagtccccttgcactcctatagttagtgttttacttcatgtcagctgtggagaaataggcacagctggcttggtgtatctgtcagctgttaagtctcaggttctgtcttctaggtaggagctaccccaggcacagcactaaccctttcctgcaggttctgattgggggccggcctttggctcttcccggctgctaatgctatctccttcccaccttcaaggctccctgccctgagctgtccctcagggttctccatagtccaatcctgacttttccagccttctctcacctcctcctttacaacatacacctactgctgaaggggctttttgatgccccctgaacatgactcacagtttcacacatttgggtcattttttttgtttttgtttttgtttttgagatggaatctcgctctgttgcccaggctggagtgcagtggtgcgatcttggctcactgcaagctccacctcccgggttcacgccgttctcctgcctcagcctcctgagtagctgggactataggtgcccgccaccacgcctggctaattttttgtatttttagtaaagacgtgatttcaccgtgttagccaggatggtgtcgatctcctgacttcatgatccgcctgcctcggcctccaaaagtgctgggattacaggcatgagccaccacgcccggccacatttgggtctttatccatgcggtttgtctctaccaggaatggccattgttttggctgtaatttctgttagtggaacgcccctcctaaattgctatctcctccatgctggccttctggattttcctgtatgaatttgctgtcttcctccttttgaaatcttgtaacattaaagtaacattaaaatatgggcttgactgtgctttcaatgatagcttctctgcttgtagcagttcctccatagcctgtaagtagtaagaagagttacaaatctaaccctagccttgccacttcataactgtgacttagggcattgagttaacctgtctgaacttcatctttagggtagagataatactgtttatttccccagttgttgtaagaattacataagttagtgcatgtaaaacacctagtatccaccagacatgcaataggcactcaagaatcttaagttacccatattcccacatttcttattacctcttcccccaaatacacacagatcgtcacacacaaacaatactactgctgctaccaccaccacgatgatggctcaatgcccagtgtgtacaggatcacagcatgctagcgctataaagttccctagcagcccatggttttagtcactgttttgcaaacgagtaactagcacctgggttgggatcagctgccctaagtgagtacagtattgcagctaacatttactgggtacaacaccaaggcattgtacttggtgttttataagcattatcttatttgagcctcccaatgaatcccctgtggggttaggtaataacattttcatcacccctattttgcagagtggtggggggccgggggaccaaaacttagaggttaagtagtttacccaatatctcacttttctaataagttgaagagctagaatttggaccccaggagcccaatatcagatcctggctcttaaccagaagccagaatgaaagtgaactccagatagcctgcattattttaagagtcctctccagtgtctcagaaagggcttcagaaattcagaaaaagctcatttcttgattcccatgccagggctatctgcccaggggagctgaattgaacataaatgaattctaccagcccagatccctcaccctgccagtctcagtcttctcccggaaaagttaaaatgagttccctgagctctggctgctttctagtggggagggagttccagtggctttgcaggaggggagacttggaagaactccaccaacttagtttattccaaggcatgcccaagaaatggattttcttgactctgtcttggctgagacaaaacacacacctctcttgttggtctttctgagttgaacagtcttgtggccttaatgcctatcacattggatggtttcaggaaagggccattctttgctttcttggtccatgaattcagagctgggttgagcagtgatgagaaaatgaaccccctagccccagccagccctggatcctctcttgagttcattctcctttggcatttggtaagcaggaaccttgatgtcccagatggtagagccaagggatggccccaggcaattcatgcagatacctcagctggttgtagtgaatcattgtgtctatgcaagaaggacttatgagcactcagtgggaattctgtacttcaaatagcctattccaagtcaagctcattatcctgccaccctgaactctactccaaatctcctcctcttccttcatcccctctaacatggccatcatcctcccagtgctatatttatagacttgggcgcctactgagactcttttgtcttccttattcatgagagctcattagtcatgaagttctgtgaatttttgtaatacacttcatggttcttgcaactattgctgtcctctttatacccagtgctactgcttcagatcagggcctcaagtactctcaccttattattgcatcacttcctaactggtcttgctgcttccaaccttatgtctctcgaagccagtctctccatagccattgtgatggctctaggtctaaacatttcacttccctgcaaacgaaatccttcagtggcaccttagttccctatgggaaatgtccaggctcttttatccggcctgaaaggcccaccatgacctccagcttcaccattcacctccctgcccagcccacataagccggccatgccaagccactgcatggacctgactgtttgcacatctgtatctgtaaacacaccttcccctcctcctagaatgtccttcccccccaggttcatctggaaaactcttactcatccttcaaaaccctgctcaggcttcaccctccaggtagagatgctcatgcatgcctctctgctaccatcatgcccacaacatacctctattaaggcctctactgcttcatattgcaatgatttgtgtacagcgcatctcccaggtaaaatgagagctgcttgagggccagacagtggtttatagaaattatttccccaggacctagcacagcttctgacacaccataagcactaaatatactttgttgatatagatgatttttctgaattgatccaactgattcctttcacaagcacaaccactgcagggaagaaaaatagtcttcttacttaggaaaaaaattacttgacatgtcttaactgtaaaacccttgaacaagcactttatccttcttctgtggttactttttcttttttattgtgtcgctgtggtctggataaagttgtctgagttttattcatttcttaactctgattgctatcttgcaagggggatgggatgaaatagcaaacaatatattctagcttttttctttcccagaggcatatatagaacagcctctgaagaagtattaatattggaaaagatgctattatctgcattatactaattaatccatacatctacctgtcattctttcttttctatggcttttctcaccgcagtggtgtgctcttccgctgctggtaaattggcacaataaatctggggggaccacctctatttccagcagttcacttaacattttatcacgtggccgtggactcaggattgaagtcagttaaaaagattaataccatttaataccacccagaaggaagatgccagaagtctgtttaaggtcctgttattcatgtcttcatttcctttgtgcgtgtattgtgataagcatagccatcctttttaggctgctgctaataactacttaaaatgattaaggtaactagttatttcctgtaagaaaattgcgctgctgtcattaacacgaaattaacatggctcccatttcatcttcagcacacagcctgttgccccccgttgccttaaacaaacagaactgtctccagaaggctgtgcgctcctttgtaagaggcaaggaggtaagaaagcgtagttttgcagaggatgctgcccatggaggcagccggaggagggaaaagcatagtcccccaaactgccatgaggtttggaggagtaattagcataattgtcattattctgtatggcctgagcaatgtgaatgggatccgtgccctttaaaattcccagttctcagtcgggcatggtggctcatgcctataatcctagcactttgggaggccaaggcgggtggatcacctgaggtcaggagtttgagaccagcctggccaatatggcaaaaccccatctctactaaaaatacaaaaattagctgggcatggtgctgggtgcctgtagtcccagctactcaggggagaatggcttgaacccaggaggcagaggttgcagtgagctgagattgcgccaccgcactccagcctgggtgacagagtaagactccatctcaaaaaaaaaaaaaaaaaattagccaggtgtggtggcaggcacctgtaatcccagctactcaggagactgaggcaggagaattgcttgaaccctgggggcggaggttgcagtgagcctagattgcgccactgtactccagcctgggcgaaagagcaaggctgcgtctcaaaaaaaaaaacaaaaacaaaaaacacacaacaactcccaattctctcaatcagtagttctcttaggttggtgcaaaagtacttgtggtttttgccattagttttaagttttaagaacaaggaccgcaattacttttgtacccaacgaataagattttctcttacttgacacatgcaagacatttgcatgtgagagacactcccatcggaacactctgcttttgagaaggatctacacatatcttgtagggacatgaagcaccgtgatgcttgtaaggtcctaagtattaatggtaagtcagcaatggctgcttattgggagtcttggcacaaataagattggctagtgctacttaagtggagtctgtgaacatgtgtgtacaagttttagtttgagtacgtgttttcagttattttgggtatatacctatgaccggcattgctggactctgtacttttatgttcaactttttgaggaaccaccaaactgttttcctatattttaaagttgagcacttatgtgtgccaggccccgagttgaagagttcacgagatagtgtacttggagggtgaacatctagagccaggaggagaccagagggccaaagtagttcaagtcatctttgggaatctgtcacagttgtccctcttgctcacttgctcttactcctctaccccactctgattgtctgctgtgagtggcaccatcagcacagccatcacctgagagcatattagacatgcagaatctggggccccacccagacctactgcaccagcatttctgggggtgaggcccaggaatctgtttttaagaagccctctaggtgtttctgatgattactcaagactgagaagctccgagatagatgtaggtgcagtgttacccttgttgctcttacatcagaaaccctattggctgcaaagtgagcgtcagatactgcttttagagatagcttttagtcttctctaacttaaatacagtgaatcatatgcaacactccccacttttagcaggttatgtgcacccacttcacttacaactgcaaaaccctaccattccaggcagagtcacctcggttccatatcatgtcaggggctcttaacttgtcacagtagaaataacccagggttatcttagtaatcctgagactgtgctcttctttaccacccaggccagcctgcaaatgtgatgatgggtctaccacagagtccatggccacagagtagccctctgtggcttcctgacagccaagagcagcctcgatttgatatctggtgtttgttttaagcctttcctttttctgctgtcaggaagtggtaatgtagtagtgtgttgaaagagcatacattttgttgtcaaacagaccagggtttgaattctgattctgctacttgagcctgcaaaatgggttaataatatctactatgtggaataatatttgttcaataaatggtggtgatatggtttgggtctgtgtccccacccaaatctcatgttcaattgtaatactcagcgttggaggtgaggcctggtgggaggttactggatcatgtgggcggagttctcatgaatggtttagcaccatccactgtgggccgttcttgtgatagtgagtgagttatcatgagatgtggttgtttaaaagtgtgtagtacctcctcccttgtgctcttcctcctgctccagccatatgaagaggcacctgctcctgccatcattgtaagtttcctgaggcccccccagaagcagatgctgccatgcttcctgtacagcctgcagaaccatgaaccaatgaaacctcttttcttataatgtacccagtctcaggcatttctttatagcaatgcgagaatgaactaatagaagtggttactgctgttattaatcattgctgataattaaaaaaaaccaaatatgtacataaaaagagggagacagggtggagtagagagagagagagaactgtcataaattcctaaagactttttgaactactgtggccctctgtctcctcttggctctagatgtttgtcatccaagtgaactattttgtgaactcttcaactcagtgcttggtacggggtaagcactcaaaacaatttggtacctcaaaaagttaaacatacaattaccatataacccaacaatgccactcctaggtatacacccccccccccaccggctgccaattgaaaataggtacccaaactgaaaactgtacacccatgttcacagcagcactattcacaataccaaaaggtagaaacaacccaaatgtccatcaatgaatgaatgggcaatttgtggtatacccacaaaatggaatattatcctgccatgaaaaggaagaaatgacaatacatgctacaatgtggatgaaccttggaaacatgctatgtgaaagaaagcagaccaaaaactcacatattgtataataatatgtaaaatctagaacaggtaaatccatagagacaggttgccagaagctggggaagggagaaatgggagtgactttaatagataatggggtttccttttggaatggtgaaagtgttttggaactagataaatgtggttgcataacattttgactgtgctaagtgccattaaattgttcactttaaaatggttacttttatactgttaaaattaattaaaaatatatatgtatatatgtttatagaacaataaaggatgaaaggctgagcctgaataactgatttacttattcggaaaagcaaagccgtttaaaaaatattttacttctgttgcttctggctataactgaaaatccctcagtccatgtggggaacacagatgacgaatacgcagccctccagcatgtgtatgtggtcattaacttggccttgctggtccagggatttcaggtaaaaatcaggaactatgaaagttattaataactcagttgcttctaagacaggtgaacatctaagacagggccataggaatggtgtaatgcagtcaagagaaaaatgtgaaggagaaggatgcaggcaagttctcctgagagacagatccaggagcataaaattggcattttttctccattaaacaatttgggatgatctgaagtctcctccaagtttctgtctctctctttatcttaattagcaaagaaagtcttaggtacagtaagccctctccttccctaatggattagccagcaaataggaaactaagctttgggagagactaataatagaatgaagggaaagaaggacaaggattgactgtagacttaagctttctccgttcattcattccttcatgttccaaagcaattgcatttcttatttgtatgctacagtcattctccaccctcaaagagtttaccatttattggtgggggtgggggacatggacacaaacaagtatacagtaaaccacagcatcatatgtcagactgtactgtgcatatgaatcctttggcaatcttgttaaaatgcagattctgattcattatgtctggggcagattctgattcattatgtctggggcagggtctgagactgtttttctttctctttttttttttttgggatggagtctcgctctgtcacccaggctggagtgcagtggcgtgatctctgctcactgcaagctccgcctcccgggttcacaccattctcctgcctcagcctccctagtagctgggactacaagtgcccaccaccacgcccagctaattccttttttatttttagtagagatggggtttcaccgtgttagccaggatggtcttgatctcctgacctcgtgatctgcccgccttggcctcccaaagtgctgggattacaggcatgagccaccgtgcctggcctattttttttttttttttaagacagagtcttgctttgtcaccaggctggagtgcagtggcgcaatctcagctcactgcaacctccaacccctgggttgaagcgattctcctgcctcagcctcccaaatggagactccgtatttctaagagcacagaggtgaagcctgtgttcctggtctgaggggctagagtgtgataaccacaataaaaaggagatgccgtacagcagattcagcaaacagcctgcaggccatatcctatttttgtatggcccatgaactaaggatggttatacatttttaaatggttgggaaaaaactcaaaccaaaacaattgaagaaggctgtttcacgacaactgaaaattatataaaattcaactttcagcatctgtaaacaatgtttcattggaacagtcacccctatttgtttgcatattgtctgtgactgctttcccactacaaaggcagagttgagtagttgcaactgagaccatatggcccacgaagcctaacatgtttactatctggcccttcactggaaaaaaaaattgtctatccctggtataaagtaatatgggatttcaagagagagggaaagatcatttccagttgtattcatcagggaagacttcatggaggaagagtatatgagtagcttgaccagtgagtaggatctgagtggcagccgttggggaggaaggaaatctagtaaatgcataggcttggaaataaggaaagcaggtggcatgactacagatctcagtgtcgaaagccttaagccaggttgctgtccagactgccagcttccttctgaatgggaaagagaaatgctctgacacaaagaaactctggttcccagctctggaagattaaaccaattgggcaagtgtatggtggactacatgtgtatccgtgagcaataatgaaggccaggtataacagtggatttctgggtgagcatttggaagccagtggttctcaaagttggggagtgacactcccgcaccctgttccccagggagtgtttggaaacatctcttttgggttgtcatactaattaggggacatctcctgatacttactccccaggagtcaagaatgctaaaggatttacagtgggatgcagaagactatagttctgggcaaggtcacatgtcctcccctgaatgtcaacagcaccctcaataacatgctcagtctgaggactcttctgtggtgtagaatgaccataggttgagaaattaaaagacttggatgaagggaatggaacccacttggatagtgatgaatggagaccaagcaagagggcagattgatgctattgcttggcagtgagaccaaaagacttccatttcccccccaacattcccagagagccagaatgccagggtagagtacaaatccaaagagaatctatattgtagggaatatttatggtgcctatgaaagataagatttgcatgatgggtgaaggtcaatgacaattatttattcacaaccagtcttccagccttaatctgcacagtggttaggtggctagctttgcaatcagaaagagctgggtatgatttcagctttgtctcttcctagctgggaaacctggataagttattttaaattttcttgttttctgatctgcaaaatgggtatggtaatagattgttttaagtattgattgagataatccgtggggcaggcttagcacaatattggggccctcaggggtgccctgtaaatgagtttccatctctctttgcttcaatgaacacgaactgattttctgatgccatcagtgctgctgttggcatcagaatagcaggtgggaaaattagaggggaaccaattttagccatgcatagcattggttgatataagggatggcttctcaatcttggcactgttcatatattgggctggatagttctttgttgtgggggctaccttgtacattgtaggatgtctagtagtatccctggcctctacccactagagacgccagtagcacccccagtcatgacaaccctaactgtctctagacattgccaaatgtcccctgaaaggcaatatggtcctcgatcgagaccactggtttaaggtaagagaaaaataagtcgtggctgtttatctttttatacaaatgtaaggggtacaattgcagttttgtcacatggctatattgtgtagtagtaaaatatgggcttttagtgtaaccatcacccaaataacatacattgtagccatcaggtaatttctcatccctccccctgccacccttctgcgtctccagtgtctataagtccatactctaggtccatgggtacatattattaagcttcacttagacgtgggaacatggggtatttgattttctgatctgtggctgtttggggtgaagggagaaatgcaggattgctttgatttttgtcttagcaaaaaatctgaccataaatctccaagctctatggtctgtaaattcaacaacataccatgttttcccctaatgccaggcactgcattcgatcctggggacagatagaaataagacatggtccctgttctctaggtagggaccacctttttttgcagagccccagctgaggaagaagactcttgaaaactctggccatgaagtggccatttgttttccgggcagagtctgccatcgggtttctaaaaaacgtggttgggcagccacactgataagatgggaggccaggtggatttatgtgggtgtttattctgagagttgggccaaggcacaagctgaaaccgctggcaaaatgaaacttcccctggccactgtgaggaggctgaatttatctcaggggatgtggtttggttgacaagactgattatatggggtttattgtttacatgagtataatatactcagggctcaaggcagaaggtgggttttataaatcagcaggtaagtaaaataaatgcgttgggctagatactcctgctccctggataaaggtgaaaggggatggtgaattacagttaacacagaaaatgaagagaattcaaaaaacccagcggattccttcttaagcgaccatttactgccaccacccaaaggcttcatcccatttaccccacctacccatggccatatattctatgagaacattctgaaattttgtatatacattggaaacagaagcttgtctccttaccattaataaccaaatgtaaggaaatggaaagacggaacacgccctgataaacgtggggcaaagaagggaaacctgacgttgatgaagggctcctctgtagcaggcacagtggcgggtgcttgatacatacatcattccatttaattcacacaaaaatcctgtgggtggttatttcccaaatttgcctgcttataagaaccaccaggcatgcttattataaatccagaggtctttgtccctcccttggacctactgaatcctactgtctggggaaacatgaaaatctgtatttttaaccatcacttcaggggtttctaatgatcggctagattggaaaacacttcattaaactgtaattcatcatccccaagttatatggatgtggaaagtagctttgcctgacccttaattctaaacccttttcatggcttcatggtgcctccttagaaatgacaggtccaattaagacacagacaagatgggtttaaaatttgcctctgctttgcatatcagttccttagagctttgagagtcagtgtggtggagaggacatgaccgctgtaactggagtccaaggactgagttacagctctgtaatttattagctctgtgaccttagacaagttagtaaagctctcctggtcacagttttttcttctgtaaaatggtgattaaaaaaatctcacttgctccgactgcttccagatccattgtgtggaccaaatgagataatcgacgggaaaacgttttgcaaatggtaaagccgcctgtgaggtcttaatattatccattcctgatggagttgataccccaattatctgtgtaaccagtttcttttttgtgcaatacgtaaagctttgaacttttcttctcacttttgggtgacttcagacagcgtggatgatgtgaaaataaggaattcgcgtttattgacagatgaaataaaggatgaaaggtgctctctggcaaaggctgctactaaatgcaagaaaccccgggacaagccacccactgaaggcatgtgcacatgtgttctctgaaactcatgatatgtggcagccagtgctccactggattaacatggataaatgaatattaataggaccaccactctaggaaggataattgggggttgcctagatcactctctagtgactgagactgtcagagaaccttcagactcctaagcctggtcccaccctgcggcaggctgaataaataggtctttaaagatgttcatgttctaatccccagaacctgtgaaaatgttgccttacatggaaaaataactttgcagatgtgattaagttaagggtcttgagaagaagggggagattatcctggattatctaagtgagcacaacataatcacaaggatccttccaagtgaatagtggagcagggagagcacagaagatgtaatgtgggaccagagattggagtgtgatgagtgtgagaaggcgtcaactggccattgctggctttgaagatggattctgccctacagcctccagaaagaatgaagccctaccaacacgttgatcttagctcagtgaaacccactttgggcttctgacctccagaactataagataataaatgtgtgtggttttgagccactacgtttgtggtagtgttagagtagccataggaaaccagtgcacccccaccgttcccagtgtttatcagtggggtgctattgtcatgtgagtggaggctggtttctagcatagcagggcacctagcatctgattaagtactaagtgccagcctcccaaatcatttaactacccaaaacgtgccatgccctggttgaaaggcatagcttacatcgctgacacatctggggactaaaagaacatgtgggaatgggcttcagaggagcagaattttaaaaatacatttaaagcttaatggttctctttagtattaatttgctcactatgagattggaaacttctttatgcctacatgacctctgtacatccggatccaccacctggcccagagttggtgctctcaaagtgattgtgaagaaaataaatggattctttgattatatctcactcctccaaagagaatttataatgccttaaaatattaaaaagtgtaagctgaaaataatgaaatcaaatgccattaaaagaagcagagaaagagatacctagatgcctggggtgggtggtttgtttcttagctccacatttggccttgaattcctgactgcaaaaattagacaggcattacccacttgaacaccttcttaggtctcacatgtgggtcaaaggcaaattgtaggatgttaggagggacatatggtttaccagatatagccatctgaggactctcatgctaaaaatacaaatatatgtttgatctccagaaatatcccttacaattaggctagggatggttgaaaaatacacccagcttgattagagatagccagaggcatgctgctgtgaacggtttattattgagatttttggaggctatgaatgatggggaagatggcatgaagacccagatttgccgtctgtaaatcatttgagactctctctgtgtcatcatcaggactggaagggaagtcccataggctgggagtgggagatgggagggctagagtgtctttgtgtcctctggtaaagaaaacaaacccatctccagccccttgtgtctcctcctacctctgcaaagctgccaggtacaactgctctgtgttattgatgctaatgacccacgtaatggccctgcaagaaggatttcaaatctgcaaatgatggcttttgcaggcaccacaaatcactgagccttgcaatcaaatgcagagggacccagatcactgaaggacttgggataatgaatgataaaatgcagtttaatgtggacaaatgtaaaataatatgtcttggaacaaacaatcagaaggaggaacagctgctaaatgaattggtttgcattacactgaccagggaatagaaatgggcctgagtggcagccaaacaatcaacagaggtgaaggttgaagaggctggtccctgttgtaggaaaataaccccagaaaagtcagagggaggaaaatgatcaagttaattcctgcctcacaggcacctgatacgccacaaagaggaatacaaatggcctgacacccattctgagctcaatgctggctgttgctgcttaagctccttgccagctcctctgctcaacctccaaacctggggtgccccagggattggggggctaacacggtttggctgtgtccccacccaaatctcaccttgaattgtaataatccccatgggtcaagggcagggccaggtggagataattgaatcatgggtcggggggggcgtctgtttcccccatactgttcttgtggtagtgaataagtctcatgagatctgatggttttataaatgggagtaaccctgcacaagctctcttgcttgtcaccgtgtaagacgtgactttgctcctcattcacctgccatgattgtgaggccttcccagctatgtggacctgtgagtcaattaaacctctttcctttataaattacccagttacaggtacatctttattagcagcataagaacagactaatacaggtgccctaggacttgggccttggctttctcttcttcagcctcactatctcaccaaagtatctcaatcagtcctgtggcttttaagaatcatctataccctgaagatactcaaagttacaccttcaattgacctctccctagcttagatctcttagtcagtggtctcaaagttttctatgtattagaatcaccttgaggatattaaaaaaaatcttaatgtctacaccctagatgaatgaagtcaagatctctaggagtgggcccaggcattagttttaactctacaggtaattccaagatgcagttaagtttgagattaagttgcccacttaatctctccacttggatgtatacttagtgtctcaaatgtaatatgaccaaataaacttcattattatccctatttcacacttgatcatctcacacttgatcagtggatggcttccccatccactgatctctcaagccccaaaagtaagcttgatactagttgtttattttctctcactacctacagctactccaccagcaaagtcttcagttccaacttgaaaacatccaacgtcattctaccatcaagtccaacctgtaccactgcaagttttaattaatctgcttacttttggctcttctctactcacttctccctcttgtatccaaagtaatcttaaaaccaggtcatgtcacacccctatttaaaaacctccagtggcttctatcccatgtcgtataaaatccaagctcattgtcctgacttttgaaaccctcaatgactttctacatcttacctttatgatctcattttgtatcattcatcccttatccaccaggctcattcccatgtttgaaattttgcaccatttcatttgtgtaaaatatacttcctttgatcttcacagggctcactgggtcttgtcatttagatgacaccataaaaatgtctccttcttagatcattcttagtcattcaatatcaattagtcatttatcaccatgtagtattttcttgtttgttacctacaagccctcaccagaatgtaaattccacgaaacagggacctagtctattttgttcactgctaaattctcaatgcctaatatagagcctggcacatactaggtgctcaataaatatatgttgaatgaatgaatgaatgaatgaattctatcaatgaaagaaagcaaggcccagagaaactagcttaagattttatagcttatagtggccatgctctatggtttgtaccagtggtttccgggtcaagtttttgtcaatccatagtgaaatgagaacaaagacatcactgtggttctatcaaatagaaacaacttgcttatattttgagattatttacttattgcttttttgatattaaaatgtccttgctcttataaaatgctattgataatatatgacaagttatttgggagtttattttaacttcctcaacaaaataaaaactgtgataacccaataaagtttctagttttctaaaaaagttataattgtggtatccagccttcaagaatactccttaatgattcttgccacctgatattcatgctcctgtgtggttccctctcatgttgcgtagagttgaactgtgaaaccaacaggatattaagtaaatgacagtgtgcgacttccagggccacatcataaaacaccacagcttccttcttatgctcccttggatcacctgctttggggggagatggctgcaatgtcatgtgaacactcaagcagccctatgggaaatgtgtgtggtgaggaactgaggcctccagccatcagccagcactgattcaccacccatatgagtaagccaccttggaagtgaatcttctaccccagtcaagccttcagatgacttctgccttgggtgacatcagactacaacctctcggaagacccctagccagaactacccagctaagccactcccagattcctgaaacagtgaggtaatgttttttaagtcattacattttgggataatgaattatgcagcaatggataactaatacattgattaataacattccaaaaatctggagacctgcattgctgtaatcttttttgaattacggtttgcacgactggctagtttaaccactaaacatctctaagctttagctttcttgtctataacatagaaatagtattcatccctacttcttaggttgctgtgaggattaagtgagatgatgtctgtgtttggaactaatattattgaatgttatttttatcattattcttgttttatattattatggactatttcatgcctaaatgatttgcagtaccatcttctatgcctgaattgtatccctttccccatctgcctgcagaattacactttattccagacctagtacaagtatttatactctttgatgcccttcttgaccttagaagagctgatcctttcctctttgtccctgtattcttttctctattatagcacttatcatgtgtattacaattagttactgacatgtccatctcttctaccatatacaatcctaccaagcacttatttggctgttattacaggccaggtgttgtcctaacacttgtatatattgactcatgtaattgttacaataaccctaagaggcaagttctatttttatctctattttatataaggggtaacggaggcacagatttaagcacgcagtagagccaagattaaaacctgggcgtttcagctcccaatgtggtgctctcaaccatatcatccctcagagaaagggagcaccctatggacagagaccttggctcacttatgttggcctccctagtacccactagagtttttggaatatgggaagcttgtaataaaaataacagcaattattatctgctatataaaatactatgctgagaactttacaaagcagagattttaaaaatggccatttacaaatgagaatcctaaggcttagcgaggctaaataacttcatgtaaagctcctagaggtggcatagcagtcaggattccagcccagggccatttgattccaagggccattcttttttcatggcatcaaacacgcccaatgattttgaatgaatgaatgattacatgaatatgtgatggaatatcatttgtcataaattggcaaaggagaaagtgaatgatccgtgtgtacttatttctactttgagataaatataatttgaaataataatggggttattgagatataaggaaatgatgccacagaaggaagaacattgattttgtgctggacagctttctattttatgtggcctgctgattgccagtgacaatttccagtatagagactgacatcctttacaatttgagctgtccccagcctccatgtgccctgtggtgcaggcaacatgccttttctttctcttttttccctccctttcttccttcctttagcattttaaaatttatttatatttttaactgacaaatgaaaattcaatatgtttattgtgtgcaatgtgataatgttttgaaatatgtatacattgtggattgactaaatctggctaattaacatatgcattactttgtatacttgtttgtggtgagaacacttaaaatctactcttaccgatttttttttttttgagatggagtctcactctttcagccaggctggagtgcagtggcatgatcttggctcactgcaaccaccacctcccaggttcaagtgattctcctgcctcagtctcccaagtagctgggattacaggaacacaccaacacacccagctaatttttgtatttttagtagacatggggttttaccatgttggccaggctgatcttgaactcctgacctcaggtgatccgcctgccttggcctcccaaagtgctgggattacaggcgtgagccaccatgcctcggcccctctcttagcaatttttaataccacaatacattgctattaactatagtcatcatgtacagtagggctattgaaattattctaactacaattttgtatattttgactgacatctctctaatcccccaaccttcctccagcctctggtagccaacattcttctcttcacttctatgagtttaactttttaagattccatgtgtgatatggtttggctatgtccccacccaaatctcatcttgaattatcgctcccctattccccatgtgtcatgggagaggcctggtgggaggtaatcgaatcatggggatgggtattcccatgctgttcttgtgatagtgaataagtctcatgagatctgatggttttacaaagggcagttcccctgcacatgctctcttgcctgctgccatgtaagacatgcctttgcttctctttcaccttctaccatgattgtgaggccttcccagccatatggaactgtgagtctattaaacctctttttctttataaattacccagtcttgggtatttcttcatagcagtatgaaaatggactaatacaacatgtaagtgagatcttgtggtatttgtgcctggcttatttcacttagcatgtcttccagattcatctaggttgtctcaaatgacagaatttccttcctttttttttaaggctgagtagtattccattgtgtatatccactacattttctttaccattgctccactgatggacacttaggttaatttcatatcttagctattagaaataatgctgcaacaaatatgggatgcagatatcatttcaatatactgattccatatcctttgggcatatatacagtacagggattcctggatcatatggtggttttacttttttgaagaatcttcatactgtttccgtaatggctgtgctaatttgcattcccatcaacagtgtttcagggttcccttttcttcacatcctttgcacatattctccaacacttgttatgtttcatctttttgataatagatattctaagttgtgaggtaatatctcactgtgattttcatttgcatttgatgattagggatgttgaacattttttcatatacctattggtcatcggtatgtcattttgagaactgtctgttccaatcctttgcccatttttaaatcaggtgtttttactactattgagttgcttgagctcctatacattttggatatcaacttcttatcaggtgtatgctttacaaatattaatactttccttctgtaggttgtctctacactctgttgataatttccttggctgcataaaaggttttcagtttgatgtagtcccatttgcttttgttgcttgtgcttttgtgttcatatataaaaaaaatcattgcctaaactaatgtcatagaccaatgttgccttatgttttcttctagtagtttcatagtttcaggtcttacatttaagtctttaatccacttttagttggctattgtggtgcatggtgtgagttaagggtctaatttcattcttttacatgtgactatccagttttcccaacaccatttattgaagagactgtcctttccccagtgtgtgttcttgacacctttgtcacccttgctatcatattggcctgagtcactttcagatgttgctgagaaaaaaatcccaacccatgggatacttaaaacatggctcttaaaacttgatctaaaagtgctttagctaattgagatgtattgtgattccatatgaattttaggaattttttctatttctatgaacaatgtcattggtattttgatagggattgcttgaatcagtagaccattctgggtagttcagatgtttaacaatattaattcttccagctcatgagcatgggatatctcactacagttttttgttcctcttcaatttcttttcttagtgttttataggtttccttgtagatagcttttacttctttggttaatttattcttagggttttttttttttttttggtagctattgtaaatgggattgatttcttgattcctttttcagattgatcactgttaacatatagtaatgctacagtttgttttctatctacctacctatctacctatccatcctatctatctatctatctatctatctatctatctatctatctatctatctatctatctattttaccatttaccatgggaatgataggtttttttaaaacctaagattatctcatttgcagacaaggataatttgatttcttcctttccaacttggataatcattttctttctttctcttgcttaattgctcatgaccactccagtactatgttgcataaatgcagtgaaagtgaacatccttgtcttgttccagctctcatttctgtttatcaatgaatagtatttcattgtgtagatgcaccatggttaatccattaattattggcctattgaagggcatgttggtgtttctaagttttcacaattatgaataaagctcctataaatatttgtatgcaggttttcatgtggaaataagttttttattaatttaaatgaacaccaaggagtgttattatgaattgaccagtttcaactggccgtgactggctttgactggttttgagcagccatcactggttttggctgtccacgaccagcttcaacttgtttccactggttttgaatggtcttggctggtgttggccggtttcaacaggtcttagtcagttggtttcagccagtttcagccagtttcatttggttttgactggtttcaactagcttctgcgaatttccatgggttataacagatttttactagttatagccaatttggactagtttcagccaatttggactagtttcagcagggctcaactggttccagctggttttgactggttttagccagcttcagccaatgttgactggtttcattcagctttgaccagtttcagttggcttcagccatctgttttgactagtttcagctggcttcaactggtttaaagcagtggtagccagttttagctggttttggctggtttagaacagtttagactcctctgggtaattatatctttttctctttaaaaaaaaataattttaacatttttgacttggggttatatgtgcaggttacctgggtatattgcatgatgctgagtttggggtatgattgttcccatcaccaaggtactgagcatagcacccaatagtttttcagcttttcaccccctatccacccccgaccatctagcagtccccagtgtttgtgtttgtcatctttatgtccatgagtacccaatgtttacctcctatttataagtgagaacatgcagtatttggttttctgtttctacattaatttgcttaggataatggcctccagctgcatccatattcctgcaaaaatcatgatttcattctttttttatttctgtgtagcatttcatggtgtatatgtaccatattttctttatttgattcactgctaatggggggcccctaggttgatccacgtctttgttattgtaaatactaatgtgatgaatagaggagtgcatgtgtctttttggtagaacaatttattttcttttggatatataccccataatgggattgtgaggttgaatggtagttctgttctaagttctttaagaaattcacccccggctggacacagtggctcacacctgtaattccagcactttgggagactaaggtgagtggatcacctgaggttgagagttcgagaccagcctgaccaacatggagaaatcctgtctctactgaaaatacaaaattagctaggcgtggtggtgcatgcctgcaatcctggctacttgggaggctgaggcaggagaatcgcttgaacccgggaggcagaggttgcagtgagctgagatcatgccattgcactccagcctgggcaacaagagcgaaactccgtctcggaaaaaaaaaaaaaagaaatctccaaattgctttccaagtggcagaactaatttacattcccaccaataatgtataagtgtttcctttttctccacagcttgccagtatctgttgttttttgactttttaataatagccattctgacttgtgtgagatggtatctctttgtggttttgatttgcattcctctgatgattagtgatgtggaacattttgttgttgttgttcacttgtatattttcttttgagaagtggctgttcatgtcttttgcacactttttaatggggtttttttttttttttgcttcttcggttgttaaaatttcttgtaggttctggatatcagagctttgttggatgcatagtttgtgaatattttctctaattctgtgggtggtctgtttactctgttgatagcttcttttgctgtgtagaagatctttagtttaattcggtcccacttgtcaatttttgtttttgttgcaattgcttttgaggacttattcataaactatatcccaaggctaacatccagaatggtgtttcctaggttttcttctgggattcttgcagtttgaggtcttacatttacatcattaatatatcttgagtgagttgacttttgtataggtgaaaggtaggggtccagtttcattcttccgcatatggctagctggcttttccagcaccatttattgaataggaagtccttttctcattgcttatttattcccactttgttgcatatcagttagccatgggtgtatggcttatttctaagttctctattctgtcccattgttctatgtgtctgtttttgtaccagtaccatactgttttggttactgtggccttatagcatagtttgaagttgggtaatatgattcctccagctttgttctttttgcttaggattgctttggctactcatgttcttttttggttccatatgaattttagaatagttttttctatttttgtgaaaaatgatggtagcttgataagaatagcattgaatctacagattgctttgggcagtatggccattttaacaatattgattcttccaatccatgagcatggaatatttttccatttgtttcctgtatgatttctttcacagtttttgttttgttttgtttttgtttttgtaattctccttgtagagatctttctcctctttggttagatgtattactatatatgtgggtgtttgtgtgtggctattgtaagagggattgtgttcttgatttgactctcagcttgaatgttatcggtgtatagaaatgctatatttttgtacattgattttgtatcctgaaacctcactgaagtcatttatcagtgccaggagctttttgacagagtccttagggttttctaggtatcatatcatcagcaaagagagatagtttgactccttcttttcctatttggatgccttttatttctttttcttgccagattgctctggcaaggacttccagtactgtgttgaatagaagtagtgagaatgagcatccttcactttttccagttgtcaaagggaatgcttccagcttttgcctattcagtataatgttggctgtggttttgtcatagatggctcctattattttgaggtatgtttctttgatgtcttgtttcttgagggtttttatcacttagggatgttggattttattaaaatctttttctatatctattgagatgatcatatggtttttgtttttaattctgtttatgtggtgaatcacatctattgattcatatatattgaaccaaccttgcatcccaggaaggaagcctatttgatcatggtgaattaactttttaatgtgctgctggatttggtttgctagtatttcgttgcagatttttacatctatgttcatcagggatattgacctttagttttcttttttgttgttgtatctttgccagggtttggtgtcagggtgatgctggctttgtagaaagagttagggaggagtcccgcctccttgattttttggaatagtttcaatagagttggtaccagctatcctttgtttatatggtagaatttggctgtgaatccacctgatttggcctttttttggttataggttttaaattactgattcaattttggaacttaatattggtctgttcagggtttccgtttaatcttgggaggttgcgtgttttcagaaatttatgtatttctgtgggattgttgtaatgttaccttcgcagtttctgattgtgcttacttggatcttctctcttttcctttggtaatctagctagtggtctattgatttttatcttttcaaaaagccaccttctagattttttgattctttgtatggatttttgggttgccaatttcattcagttctgctcaattttagttatttcttctcttttgctagctttgaggttagttcgttcttgtttttctagttcctctaggtgtgatgttagattgttaatctgagatctttctatgtttttgaggctggtgtttagcactataaactgtccccttaacataacttttgctgtatcccacagattttggcatgttctgtctctgtgtttatttatttcaatgaattgttggacctcttggatagaaccacaaaagcataggcagcaaaaaacaaacatatagttgcatcaaactaaaacgagtttgatgcaactgtattcttctgcacagcaaagaaaacaatagagtgaagagacatcccatagattgatatgtatatacatctgtgtctatgtgttttggctttgggaaatcagtaaaccacaggactttgattttaatttatgtacacaggtaggtatctcccaggggcctcttaagaggtaataatgcaacgtaatgaaaaaaaaaaaaagcaccgtgttagagctgaactgtactagtaccatcacctatgtactatctccatgtgggcaaattacttaaactctctgtacctttgccttcctatcagtaaaatgggaacagtaacatgtattttagcttcatggtgaggattaaacataaagctctacctgacttgggcttcccattcatctctgagcttatagcctaagatactccccctacagcacatttctttccagctaccttagtttcttagtcattcctcaaattcactgggcaagtgcctgcctcagggcctttgtaccagctcttccctttgctcaaacattttcttctcagatccccaaatggctcaccacatcaagtcttggctctcatgtcccctcctccatgaggcttgtcctgactcttctgattagttctgtatcctcctcctgccactctcaagaccctttgctttgctttctcttctttccatagcagttaacatctccttgtagatgagacgttgtatttattaattagtatctatctccaactgctagaatgtaagccatatgagggccagggtcttcgtgttttacactggtttatccccagcaactagaacacagcctggcacatagaaggcaccccataaatattcactgaatgaataaacaaatgaatgcatgaatgaaatcactcagtacagtgcctggcatattgtacacatctaaggaatgtagctattattgttgttacctggatttccccaggatacttcatcctggaactgtgaataattttaatgcccaatttcactacttgccaaacctgcacatctgcaggtgtcaccctcctttttgactactaccctgatgtctcctccagtcatttataattggggcccaggtggccatctgattttgttctttagctctggacttgtggtggcatcatgtacttgaagtcctatgggggtggcccctctctgtccagcagctgctgccctctgtgggatgctgctttcctgcctccctgctgggtcctgctgcttcctcatcaccttgccagacacagcagatgctgctgctgctactgttgctgcttcccatcctttctgattgctgtcgctatgttctccctagaaactcagaaaatgctctgctccctcaccttccgtctggctggctcatctggaccctgaagtgaagcagcgtgtgctccaagcctttcaaggtcactggacgaaacaagtcttcttcagttttcacttaggaccagtatctgacaaagagatgccatcgtgcccttaatgttcttgtctcccttctgtttttcttcctgctttactgaggtataattgatagaaggcaattgtatatatttaaggtatacagaatgactttttaatatttgtagacattgtgaaataatcagtcaaattaattaacatatccatcacctcacatagttaccttttctcttttttctttgataggaacacttaagatctaccctcatacaaatttcaaatacacaatacggtattgttaactgttgtcacttatagtgcattaaatctccagaatttattaattttgtatactgatactgtaccctttgcccagatctcctcatttgcctctccttccaacccctggtaaccaccacctactctctgcttctgtgagcttgactattttagattccatatataagacatcacatagtatttgcttttctgtgcctggcttatatcacttagcctaatgtcttccaggttcatccatgttgcaaatggcaggatttcctttgtttttaaggctggatgatattccattttcattacccattcatctgttcatgaacattatgttgtttctatatattggttattatgaataaggctgcagtgaacacgagagtgccaatatctgttcaggataaaaattttatttcctgggccgagtgtggtgactcacgcctgtaatcccagcactttgggaggccaaggtgggtggatcacctgaggtcaggtgtttgagaccagcctgggcaacatggtgaaaccccgtctctactaaaaatacaaaaaaattacccaggtatggtggcgggcacttgtaatcccagctacttgggaggctgaggcaggagaatcgcttgaacccaggaggtggaccttgcagtgagccgagatcatgccattgcatgccagcctgggtgacaagagcgaaactccatctcaaaaaaaaaaaaaaaattatttcctttgggtatatacccagaagtggggttgctggatagtaaggtggtttgaggagtctccatagtgctttctagctttctttgaactaacctcctccccttcttgcaaccggagacacacacagcccccaggcctactaattcctgcaaatgcttgtctgccagcaggtggctactggtccctcatgttcagtttttgcttagcttcagcgaagacatccctcgagagcataagaaaaaacagtcatcatttttaaaaatacagaaaaaatctattgctttattgcatgttggtagactgctgttccctttgacagtccagttctgcatgacaagtctacttgcatgtcccgacagatggcccatggtaacggggcattgctgatcttgttacaatgaaatctattcaatgaaaaattctccccagcagatgtgtataccagcttcatccccatgtgggtatcaatctctttatgagacattgttttggtggtatttataagcagacagttgtaggataaagagagagaggtgactgctattagtattaattatgatctcttgcatttagtgcttcatgctttttcaaaaatgtttccacagctgttcctttatttgattcttgcaacatccccatggggtagacatcagagatgaagggagaaggcatgcaaagtactttccttccttcctttcaagatgttagaataagtttgcaccatggttgtggccatcaggtggtaggctgcacgatgctgcagagagaactagactgggaatcccagctctgcctttgaaataggagagcatccttggagaactggtgaatgtcccggtcagtgaagtagtcttagccgggttgctgcagtggccgcctaacaggtctcactgctgtctttgtcttgcttccatctgtcctcagtgcagcagccagaggggatgttttaagtcatacttcagataatatcgctgcactgctcacagaccctcccaaagctctccaccccactcagagcaagagcagaatcctggcaatggctgacaagacccctgggttttgtccgacatcttctctggccccttctcccacctccgtttgctcatgctctggccacattggcctccttggtgctccttgaacatggcacagttccatgggcctccacggcacctgcttcctctgctgccacattgttccccacctgtgcttggctcaccccctcatggccttccatctgctcgtctcaccttcacgtctccgtgaagcctgtcccaatgactgtatgcttcccttgcctgcctaacctctccttcctaatccttctcacctgttctctggattgcttttcacgacagcacttaccgtcgcctaacattccgtaagtggtcacgttcctgggctgtcggaacaccacaaactgagggacatagatggagctggaagccattatccttagcaaactaacacaggaacagaaaaccaaacactgtatgttctcactcataagtgggagctgaacaatgagaacacatggacacagggagggaaaccacacaccccggggcctatgggggtaggagtggagggagcagggagggagagcatcaggattaatagctaatacatgtggggcttaatacctaggtgatggatggataggtgcagcaaatcaccatggcacacgtatacctatgaaacaaccctgtatgccctgcacatgtatcccagaacttaaaatttaaaaaaacaatttttttttcaaaagtctgatatcaaggtgctggcagggttggttccttctggaggctgggaaggggatctgtgctatgctctctcccaggttcttgtggttgctggcaatccttggtgttcctcggcgggcggcaccatcactccggcctctgcctctgttttcacatggttgtcttctgtctgtgtcccaatttccctcttctcataaggacaccagttgttggatcagggcccaccttaattcagtatgacttagtcttaacttgattaagtacatctgcaaagaccctggctccaaataaggtcacgttcagaggttctgggggttaggactgcaacatagctttttggagactcagttcaacccataacactctcatttatttatttattttttttatgtttcttgtttgtttacctctgctcaataaattctgcgaagattggggcctttaatatatgagctggtaggatcccatgatactcacaaatgtcagcttccttccctcaagttcttaatccttttaaatattatttatatccccaaatgaaagtctcataatagttaactctcaattattcacccatgtttggtaacaggccaagaaaacaatttcacagtcatttgtaatgtattgccagaaaaatcctattttgacaaattagacattctatcaaactttctagcttgcattcacattccatttacctagaggctgccacagttctacaaaaggttttacgactagagacagagttctgagacacattgtctccactcagaacctctttctgtggaccttgtagtcaccatgtgtacctccggccaccccatcctgccctgggtcttgtcctcaggttggcaccttacccagatgtcacaaatgcttctcagaacctgccaaccagactacagaatcagacccctaccatgtgagagtcagaagggatcctaaaaatcattcatttgttcactttacaatatatttcttgagtcagaagggatcctaaaaatcattcatttgttcactttacaatatatttcttgagcacctattatgtgccaggcattgtgagtttcctattctattccctttgaacctcacagcactgtgcaagatagatattatggtctctgcattccagatgagagcacagaggcccagagcagttgggagacttgctgtgactactcagctagctggcggtagacccagattcagatccagcattgcctggatctggagccctttatatgaccttgccttgaactactgggcctctgcttttcaatcactctcatccttggtggcacacaagatagccaatagaaggctggtgacaggtcattcttattctcaggcttgtagaaaattttgtatactagttgacattttctcttttacagagaatctttacctttataaatcactttcatgaaggcagaggaggtgctgtgtgatggtggcttccacctggaccccagactccctctccgcctttctctgcctggggagacccactgtgtgcatggcactcactgactcccatacctctggctatcaaaggtttctgccatggccaccctggaaggaaaccagagggaggtagacagggagatcaggtcccttctactctggttcctgctctgtgaaattgtctcaggctggctgtgtccagagggtccctggttctctcagggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagaggaatgtccaattggcctgagataagcctctggtaaaatgtactgtacataataggtaatcaataaatgttggctgatgacaaacatgttttctttgttcattagttatagtgattatgttctaaataactccaacaaggaagtcagcacatttggaatatcattatctttccatgataatatctttccatggaaagataatgatattccaaactgggagtgtccctagcagatctgagtctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcagggtcctcccttaatgaggtgtgcgatgtacaagagtcgtgaggtggcaaaggatgggctcctgaggaaacacttaggaaactgggctttctgccattaaaagagacaaacctttgtggtgacctaattaaagtttttaaaattcaatttggaaagttagcaagctaggctcctttccaggaaaaataaggagtcagtgcatgacctaaccggtcccgggctgcttgccattccaaacaactgcagtaagtttatcaccttctttcagggactgaggtttccaggcacagacttggataagaaggatgtcctatggggtcacattgatgctgtggcccaagagaggttgccatgactcgagaaaggttatgaagtatggttttcactaaaggaaaactgatctctttcgattgtttctatggaagcttgtggattataaaacagtatcctttcaaatccatccatccatgtactaacccatctatccgtccatccattcatccatccatcaatgcatgcatgcatctatcattcattcattcatccatccatctatccacctattcttccggccatttatttatccatccaacatatactgagttgctactcccaccaaacactggagattctatactaaatatgacataaccaatactttgaaagagcccaggcttcatgtaaaagcacacaattgaaacaatggttacaagcacaaggcgttaagtcaaaagaccttggtttgagagttgactttgtaatttaagtggccctgtggtcttgggcaagtgtttctctctaggccacatttttcatccgtaaaataatgtagctgaactcaaggaatgctctctaagatctcttcatggtcagatatgctaagattctctgtccaggcaaattcagggcaagatgagatcatcatgtgagtgcagacagtgcaataatctagtcagtggtctcctctgtccaccttgcccatccactctatcttctacagtgtaggcagagtcatcttttcaaaagaaaatctatcacagctgggtgtgatggctcacgcctgtaatcccagcactttgggaggcgacagtggtggatcacctaaggtcaggagttcaagaccagcctggccaacatggcaaaaccccatctctgctaaaaatacaaaaattagccgggtgtgatggcatgcacctgtaatcccagctatcagggaggctgaggcaggagaatcgcttgaagctgggaggtggaggtggaggttgcagtgagccaggatcacgccattccactccagcctgggtgacagagcgactctgtctaaaaaaaaaaaaaagaaaaagaaaaaagaaaagaaaatctatcacatcttttttttcattcatccctgcagtggtggattctattcctcttcggctaaagatcaacattcttaaggaaggtcttcgcagctcttcccagttctccagctcattttgtattaagccttgacttgctatctttgctccttaaacttgctatgttccctcttattacaaggcttccgtgtggcccacttgtacctttccccatcttctatcctgggagaactgctcatccttcagatagcagcctactcaccatttcttcagggacactttctctcacctcccaggtgaggcctggcttctatatatacacatagatcaatgtttcttccttttagagcacaaaccccaaccctgaaccatagcagaggggatccttagtttaacatctggctgccccaccagcttaccaccctcttgggagaaggaactgggtctagtttgctcactactgcactccctaaaacagtgcttggcacatacagggcccccagcaagcattcgtctgaacaaacatggagaatatggtgagtgccctaggctgacaaatataaattcctcatacccggagatgaggacaggaaatagcatccttattggggtaattcacttgaaaaaaaaaatgcctcaaaagaaatccacccatatgttgtaaactcactgctcataagagcaaggtgctctctaaaccccatcaggtagcccacagtgtctctcaaaccttaagggggaggacccttttgaaccaaaatggatgcaacaatagctgtgaagccactgctgagctgctgacggagggtagaggtgacaggtagagatggaaaaaacaaaaggccagagagacagaatttgaccaggggtctctgccactgtgcaaggtaggggtagtttttttcagtctagaatattggttaagtagttgaaaaagccctagaggaaaaagaacaatccataattgttcctgagtgtggttaaaaagcattttgagtaggaatctgtgtagcgcagtggttgagggaatgtcagacaggtctggttgaagtcatagttccagcaccgagtagctgcgcagtgctgggcaaatcactttgctctgagcctcaatttccttatttatggggataatggtatgtttaccattgggctgttggaagaagaaacggaggatgtaagctcatgcttaacacaaggcctggcctacactcagtgctcttaagtgaaagctgttgtcagtgagatgaattactttgtcataattctctgctcacctaactgtccatctggtctgcatttgattcctgagtaaagccatttgccagaaatgagctctcatggaaactgtacatttctgtggctctaaaccttgactcctctctttttctccatagcataccaagtctagcagtaatttgtgttggctctcctttcaaaatgcatgcagaatccagttgcttctctctccttttgctgccactgccctggttcaagctatcagcatctctttcccagaggactgtagtggcctcctaataggcctgcctgccggggcctttgccccctatggtcttctcttggctaacagccagaaaaaacctgctaaaagctaaatcagatcataccactcccctgcttgaagatgtctgatggccccatcacacttagaagaaaatccatatccagatccagtcccccaaaaccttcaggattccacattagccaacttttttgatcctatgcactctctcctaacacataggttccagctacagtggtcttgccacacaccaggcacactcctgcctgagggccggaaacctctctacctagaaacttgcaagctggcctttccatctcctttaggtctttgttcatatgtcacattctagctgaggccttccctgactgccttatttaacactgcaatccccaccccacactggacgccttttcctataactcatcccctactttattttacccacagcgcttgtcactatttgatccttatatattttacatatttgtctattatctgtctctcccactaagttccattacaaaagagtttttgttctttttttgttccctgttgttcctcggtgcctagattctcatagaagcaatgtgctaggtgcttaataaatatttatcatgtgaatgaatggtcagcccacttcttggggtgaagccttatgtgtatgctcagaaactgtcctggcttataaggttagtgtgggccaggctccccgagcattctttttatagagattctgctaaaatcaaatttctgaatcctctggactgcagagtcagtctggcaccttagatgtccctgatacccagcctaagctttaggcactgtgacacatacttttaaaggtggagaatgagtcagaatctgataaggtataaatatttggttactcacctcctgaaggtgaattagctctcacaggttgccagaaatatctctcggttccctgaagctgaaacacacttgctgatgtgcattaatagccaaaatggtaggaaatggcagagtctgccattattcatccacttaccaggggaggaaagaagataaatttattgtatatgaatgaattaacacaggcattgtgcctgttgagcaggtgtgcagggaaggaaagtggatgaatatgtgtgtgtgtgtgtgtgtgtgtgtgtgtgtgtttctcatgttcctatccttaatcaagaaaatggaatcccttctggaagacctcatgaccacatttgaagctctaccatttttctgttttggagaatagtggtttgggttttatagaaaaactggaggcagctctgagtaagagaaacatggtggtggtgatttcccagaactcatcgggcttctccaagttgggacacatgttggtcaaaggatgagctgctggcaattcatgatgaagacactggagtggataagacactcatggagacacttaaagcaggacaccaacctaggaaggatctggaagtagaagtgagtggaagatggcactaaaagtggaagaaaatcatgaaagacgtgatctgtccttgctgcttcagtgattacaagtgggctccagcagtccttccaatcagattctattattgaagaccagtgtattatttaaatgcttctctcaggagcttcgaaaggaggcagagcgaatagagagggaaagaaaagagctctcatgcctccactgtggcttggcactgggtgggtagggcacaggtgctggatggcaaagcattggcttgctgctctgatggccatgctgatgggacacagggaaggagaggcactgaacacttagactttcacagaattttcaatatcaatatgcaacttgtgataggttgtagttaaataaatttgttgttgtttattaaaactttttgcatcctcatgttgaggaactcaaagtagaaaataatgtctgtagagaaagtatacttttccccaggtgtgctgagtggcagctcttatccagtgacgtatactatcaaaaataccaacttggactctgtgatggttaatgttgagtgtcaacttgattgcatggaaggatgcaaagtatttttcctgggcatggctgtgagggtgttgccaaaggagattaacatttgagccagtgggagaaggagacccaccctcaatatgagtgggctccatctaatcagctgccagtgcaggtagaataaagcaggcagaagaacgtggaaggactagacttgctgagtcttccgatcctcatccttctcctgggctagatgcttcctgcccttgaacggcagactccaagttcttcagcttttggactcttggacctataccagtggtttgccaggggcccttgggccttcagccacagactgaaagctgcactctgtcatcttcccaacttctgagatttggggactgggactggcttccctgctcctcaggttgcagacggtctattgtgggacttcaccttgtgattgtgtgagtcagtactccttaataaactctccttcatatatacacctatcctattagttctgtcccttcagagaaccctgactaatacagattctgagggcagaaactcattcattcatctattcattcatatatccatctattcatttacttgctcatctagcaaatatattttgagcacttactatgtatcgggcagatgtcctgatacagaagtcaacaagatgaacaaatccctctcttgaagcttgaattacagtggggaagacaataaataaaaaatagaaaagataacttcagagagtgaagagtactgtagagataataaaatcagtgagtgatgtagagagctctgggggcttagagttcaggctacttcagataagatgattagggaatgcttctctgggaagggatcttggtgctgagacctgaacaatgggaggacccagccacatgaagatttaaagtgatgactcacaacctttgaagtgcattcatatcacctgggagtttttaaaaatagatggtggaccccacctccagaggtggaaatttaattgacctcaaggtaaggcttaaaattattctaatgtgcagccagggttgcaaagcaacctagactagaagtggaacttactagacagaatagcatatgcaaatgtcctcaggtagggaatggcttggagtgttccccaggcagaaagaaggtaggtatgactgaattagatggaggtaagaaacaaatttggggagggagtcagggattatattcgcttaggtgagctggtgagcatgtcacagatctagagctgggccccacagtacacagaagtacacagaaaacaagagctccttgctgcgtgcagtggcattgtcttgtgaggagccagggagttggaatgggtggtagggagaaaccccatacatttcacttcttcagtgtcatcacacagcaaactaatctgaactgcagaatttctctggtgatcagctgcctgttttcctggggtgatccatctatgaaaagtttccaaattgtgttaaaactgccagtttctcgacaaacagcacggagtgtactttccagggagaaaagttcaataattaaaatgagtcagcactgaagaactggagggcggtttgatctagtttagcagccgacgttttcttagcagaaaaatgcaatatccataatacataattttgtgctgaacagaagtcaactagaacagaattgtctcaggagggaccaaagtcagcttgccagaaaatctttttgaaggcagcagaaaacctggtcttcaaaagctgaagttggggagtggctgaggggccatgtctcaggtgcctacaggctggaggagctccctgagctgttttgacagggactcccctcttgctctctccagagcaattttaaagggcagataaacacaacacccaggttgtctgaacacctggagttcagaagcctgacttctcaccaccagcagaaagacctacttaatattgggcagctcttattctagggactaagtttgcctttgcctggggtgttaccacaggaggtgggagtttgggggtaattttttgtttttctgagaaaagaagagtgattaaaggagaaaatcatttcctctgggtggtaagggtccctgcaaaacatcccccgactgagcttccaggaagagtgaaaactgccaaacctgaaagtggtttggcttggagtctaagtccccaccagaggttgcaagtcctccctgtgcctgcagcacagtctcttcctggggctggctccgcgatttcaaaaacatagacaaattggctctcttctggcctcctgaagttcatgcaatcatgggaccaactaaatttgtgttagattatgccaaagactgaacaacattttgctttttttttttttttttttttttgcttcactgacaatagtccaagagaggaagccttcaattagagtagcagaaaatgctgattagaatcaatcaacacctctagaagtttaaacacttaagttaattaaatggttcagtaaacttgaagcgaaacttgcaaacagaaaacgcgacgtataaaaggatgcttagatttttaaaaaacagataattatccaacaagctcaacatcaacctcaccaaaggctctgtgaaaatgattaggcaggcagcgcattaattttcaatgcaactcacacttaggttcatatcactactcaaaagcaaaaactcatgactcctatcagcgggtgtgttgttctggtttcgagatatactattaggaaactggcaatgcacctgttgtattttagtagtcctgaatattttaagagatcactgtttccttaccctcagtacaaacaaaatcctgcaaagacagatctttcctgcaaagcaaaatcttgctggttttgtttaattttaggagaaggcccaatctgaatgagtgaaaacatgaaacacagattttttttcagacactaaaaatttgtaactcttctgctgcaaaataaagtcaaactagatgtcttctgttgggttcctttagacacagcctgcgatggagagtctagttcaagtgttttcctgaggatatggtccccagaaaaggggaaggaggaaagcgggacagagctgaaacaaatatctaagcaaagcttttgatttgcctgcagattgtttcagtctgagcccataggagggcgctggagtatgaatctcacaacaaaattagttccacctgagacaagaagatcagcctctgatgccccttggcatgtatctattagtcatgggccgtgggcttctgctgggggtgaggtgggaatgtggtagcctgttgagcagttagcagagggcagtcccccaggaaaagcggtggctgtgaggtgtaatcagacaaagtcacagctgctgggggagaggggcagcggctaccgatgggatctgggcaggaggtctacatgactggaccaaggaacttctgcctcatagagattgttgagtgatcttaggcaagacaaaagttgtctttgataaacaagcctattctaaagtgagagctaccccaggctccagacactatcttgttcacctctgaacataatgggtcatcaacaaatgtgtgttaagtgaatagcaaacagatcacttgcagtgtccactgaatatgatgcagcttccatgccctttctacgcatttcacaaacacccactgaagatgaagcaataacttgctacttgaggttcagtcccatcagaagacatgggttgagcccttgtgtagtttttcattagtaatgatgccttgtacctcagttgtccaatctttaaaatagggaaaaatcacaacatgacagggcttttgtgaggattaggagaaatagcacatgaatatacttagtaatttagctttttctcataaaatgtttttctttggaaaaatttcagaaaagctgaagtgcaggaatagagacatttaaagctaaaggattagaagcctctgataataaaaatttgctctgtaaagataaagcaatactagaactgtgctgtaaagtcaataggcaccggggattgatattgatctacagaatacacttgtaggaatgaagctactccataaagccaggcacattgagaatgagcatctcattgttttatctcccaatatagtgtgcaggtcaggctctgaactcttcttaactagaaagatagtgagttgcaaataaaacaggtgttggccattaatgaggtctctacgcacaacacttactatactacctctcagactatgtggagtggtttcttcttttgggggtttgccaaaaacaaagtaacattgcctacgaccttccttccataaaggcaggaggagggtgagtgtctttgtctgcacaggacacacagctgcaagaactctgtgacttggtgttcccactgtctgattatctgttgtgtcctccacagatcctcttttcttgcccctgctgggaagctatctctggttctagagcagaaggccatcacagaaactcagccaaacagtaaattggaggtgaggttttcaccaggaccatgaagacttcacttcttcaatcgggtaacttcccaaagaagtattttcctactttagagatgtggaaggattgggagctgctactcaagatgatcttacacatgcactgaatggtttgagcatcattcttatcattgattaaggggctggatcaacggctggacttcaggcatggtcagaaggaaaaaggagcctataattggccatttcttggctgggtcatgaccacagcaagggcatagatgtttaataggcagtgtaaggttacaattccaaatatgcattaactgaacccatcaatgatatctagcggggacaacgggaggacttgaggacaattgatgatggtaagtcatttgacaaaaatagggcctgaaaaaatacaaattttggttctatatcttttgaaaaatatcactccttagttgtcacttaagcctaggaccaaaggctagctagcttccctaatcactaggcttacttactagagcaaagggtagagtgtgggtacaggcatctgttgttatcttgcccagcatatatttatttatccctcttcccttggtaacagcacccttcctttcctttgaataactgtgcctactgcatttccatatggccctggggggcaccaatcctggtaccctgttcctgggtaggttcatgaccttacaggttggccagactcagtctcccaggaatctgaattataggtggagtgaaatatgaatggaaggtgaatgaagacaagtcaatttgatggcagttctcagaaagaatgaatcggagatccctggtactgacctgatgttcctgaccttcttgtggtccttgattctatgagttacttagtgttctctcaaataaactaatccttaaattaactagagtggcttttccgtttcttatagtcaaagaacactgagtgctccctgccatggtgcccctaaggagagaaaggccagtctctctttcttttgctctgtctgtatatgtgtgcatttgtgctggtataagcactgacaccagttcctgaggcctccataaaaggtacttcaggccccttttcaatttgagaggcagggtgtgatattattatatgttaccatccatctctttcttaaagaggcaaagtctcataggggaacaagcatagattttgcaatccagaaaaaattgagtttgactgaaaaaactgagttccgtcatttgcaatttatgtaatcttgggcaaattctgtatcctttcacctttgtcacctgtaaaatgggtacaataatacctgtcttctcacaggggtttgtgagatttaaggcagtgtataaaaagggccaagtattgtgacttgccctagaaaaataatttccttcctccctctggagctctttgggaggtgggctggggtcctcatcactatggttattttacaaggttggaccttctctagatacctgatgaggccacattcaggtgggtgggtagagacacactggtttcaaacatgggagatatgactgagaaggcgatgattgctcttgctaagacaatggacttcggtggtgatgggagaagcttagtttagatgcaagcaagaatgtgctcagatggagagagaagaaggaattacagacaaaagaaatctgcagaacaccaatttttaaatctacacctatgagggatgatttcagtttgtggcctgaggagagagtgggcagggaggaattggaaattacggctcttccttcacattcgtgattcggctaaatgggtgctcattattcagagaatgaaaaaaatagcagagcctggtaacacaagagcccttttctcaaattatcagtactttataagaattctagcttttcaataatcatagttcttatagctttatgttctcacattctaagtttgttgtggtgaaaagaacaaaataagggaggatgatgagttcatgtctttgtagggacacggatgaaactggaaaccatcattctcagcaaactattgcaaggacaaaaaaccaaacacctcatgttctcactcataggtgggaattgaacaatgagaacacatggacacaggaagcggaacatcacacaccagggactgttgtggggtggggggtggagggagggatagcattaggagatatacctaatgctaaatgacgagttaatgggtgcagcacaccaacatggcacacgtatacatatgtaagaaacctgcacatgtaccctaaaacttaaaatataataataataaaatttaaaaaaaaccaaaaaacatatttggggagaagcttccaagtaattaaaaaaatttttcctttttaaaaatttttgtgggtacataatgcttgtatatatttttgggctacatgagatgtgttgatacaggcatgcaatgtgaaataatcacaaaacagggaatgaggtatccatcccctcaagtatttaccctttgtgttacaaacaatccaattacactctttcggttattttaaaatgtacaattaagttattttaaaatgtgcaatttattattgactacagtcatcctattgtgtgatcagagagtagtcttgttcattcattcttttttttttcagacggagtctcgctctgttacccaggctggagtacactggctcaatctcagctcactgcaaactctgcctcctaggctcaagcaattctcctgccacagcctctgagtagctgggattacaggcatgtgccaccacgcctggctaacttttgtatttttagtagagacggggtttcaccatgttggccaggctggtctcgaactcctgacctcaggtgatccgcccacctcggcctcccaaagtattgggattacaggcataagccaccgtgcccggccctcattctttctaattattattttttgaacccattaacaattcccacctcccctccagccccctactacccttcccagactctggtaatcatcctccaggtaatttgattcagaattttgtgtttgttttcctaaatcaataactactatacaaaacgctgtgaaaatggctactattttctttcttttgctccccacctggggacggtcccctgggtcaccttactcagcagttctccctctagatttgatccagcaaatgagatcgagtgatatattatagactctttaatcattttcaggggaattgggttgggatggaagagccctgggcctggacgtgactaatctgagggaactggatcagtatttttgggagaagcacacctgaggcaagaaactacccccaaataaaaggatgtctaaaatgctcatggttctctccccttttttggcctcgaaaaatgatatttattcagagaaaaaaagaagagaaaaaatgccaagaagttcacccattggctaacttctctgtcccctcctggttcttgccagccccccagggttgagctctggttggagtgggtagcagggctgcccctaaggtgatgtcagtgacatggttcaaatactgtctcaccacttaccaaggtatgaacttggggttcattaagctgcagttccctccatagcatcttgtaggggaattatttaagcatgtgccgtgtaccctagtgaattacaggcctcaataaatgttgaattaggtataaaatcctttcctttatgcacccttcaatcttaagacctattactgaacaatgataggaaattggtttttcattcaacagaaagcccaaggttggtcaaggtcatggtagggccagcatttgttcatcaagtttatagtcttctgagctttgaaaatgttggcagggagatcttaactgggatgagacacagagagatgaattatagtgttacttgagtaatctatgcaataggttgctgccatctttggaaccctcacttgtgaaataataagaaatatacatattgttctctgtccccagtccctggcacagagctcctaaaacccttgtaatttcctgagtgataggagtgctaggggaatttttttgttctaatgcttggcttctgctgaagttcctgagagagagctccgaatacccctgtagacagaggtgctagaattttttagcatttggtccttgaccccaattttctgacacagagctcctaaatcccttggaatttcctgggtgataggagcatcttttgttctaatgagatgactcttggtgggcacctggctagcccaacattggcctgttggccaggaaaatgaaccatgtgattaaaagtagtactactatttgatccagcaatccagaggaaaagaagtcgttattcgaaaaagatacttgtgcacgcatatttctagcagcacagttcacaatcgcaaaatcgtggaaccaacccaaatgcccgtcaatcaacaagtggataaagaaactggtatatatatatatatatatatatatatatataatattacataaatatataaaaatatatatttgtgtatatatatacatgtatacatgtatatatgcacatatatgcatgtatatatacatatatacgtatatatacatgtatatatgtatatatgtatacatatatgcatgtatatatacatatatacgtatatatacatatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatactcactcagccataaaaaggaatgaattaacaggatttgcgacttggatgagattggagactattattttaagtgaagtaactcaggaatggaaaatcattgtatgttctcacggatatgtgggagctaagctctgaagacgtaaaggcataagaatgatacaatggactttggggacttggggggaagaggaggagggggacgagggacaaaagacatacaaatatggtgcagtgtatactgctcaggtgatgggagcaccaaaatctcacaaatcaccactaaggaacttagtcatgtaaccaaataccacctgtaccccaataatttatgaaaaaaagatttaaaatgaaaaaaagatttaaaatgaaataaaagccaaagcagcttacagtaaaaataaatagataaataaataaaaataaagtattggaactttcagctccacctcaacctccaggaagaagagagaggccgaaggttgagctaatcaccaatgaccaatgacttaatcaattgtgcctaggtaaggaagcctccaataaacactcaaaagcactgagttctagaggttcctggaaggcagtgggcttggagagggcacagaagctcctcaacccttccccataccttgccctatacagttattccccccggctcttcatttttatcttttgtaataccctttgtagtaaactggtaaatgtttctctgatttctgtgagctgctctagcaaattaattgaacccaaaaaagtggtcatgggaacatgggttacaacctgtgcttattatttggcctctgaagtggggggaaaactaagccctccatctgtggggtctgttgctatctccaagtagatagtgtcagaattgaattgaataagagaatacccagctggtgtctgctgcagaattgattgcttggttgaccgtgggaagaaatcctcacgtgttttggcaaccagaggtcacagaagtgttgattgttgaatgagaggatagaaaaaaacactttgttttttcttttctccatatctcatactactgccctgaggatgtcttctatacctctacttatagcacagcatcacacatgggaagcatggccaggtccaaaattggtcacactttcctctgacctcactccagctctttattcccttctgagagctcatctgagcataccacacatcagcatgtgtgcaaaactacattacggagaagagggatttgatgaatcataaaatctcacacagtactggaaaaagtccaggataaatgggctttgaataaaataaatgccaccagaacccccacataaatgatgcatgacatcgcctgcaaattgaggcatgaaggcatgaaattttaaactcccagatggctcctccttgttcttttcaacttgtcctcacaaaacttgtgcaatagctacacctctcaccactgaacctaggtgacacctgaggttcgcttgttgctgaaaagtagactagaaagttgagtcattggggaattgaagggaagatccatggtgtatttcccccgtagcccagcatctaatacaaatttgggacacagcaggtctcagaaaatgtttttggcatgtttacaaataggaagaagagctgcctctgttcaagagaagttaagacccatcagatatctttcattcatgatatcccagtcttatgttggggtgatttaaaaggttaagtattggctgggtgtggtggctttgcttgaaatcccagcactttgagaggctgaggtgggagaattacttgaggccaggagtttgagacaatcctgggcagcatagtgagatcgtatctttacaaaaagtaaaaaaaagttagccaggcatggtggcatgagcctgtaatcccagctactcaggaagttgaggtggggggtgtatcacaagcccaggagttcaaggctggagtgagctgtaatcccacaactgcagcctgggtggcagagccagggcctgtcacaaaaaaacaaaacaaaacaaaaaacttttgcagccttttaaggaggcaatgaagtgggctttgatccagataggctggagtttggtgctcaactctagaacataataggcataaaatctctgaaccctggttttccagcactgaaaggatgataataatactaagagtaataataattgtggtataataagaaatattatttggtttttgtctgtggttcttgccacagaatttctaaaactcttgggatttctggcctggaatatgtaggcaggaggaatcttaagtaggatgggacatctagaatgaattattctattgagtaatctatgcaataggttcctgccatctttggaaacctactgcagtgaggaagtcttctgcacttccttttatagcacagtattatatactggaagcagtggacatgcctgaataagagtatcttttgttattcataatgaacacttttaatcatatctgagtttatgctaatgaggtgacttaaggtggggaccctagatagcctcaggaagaggctggtcaccagaaccaactcagtagagggttgaaacttcagtcccatccaccagtctgaaaactggagatataagctctataaaaagtcttgaacaacaaatgtccatcaacacataaagaaaatatggtatatatacacaatggaatactatacagccttaaaaaggaaggaaattatgtgttttgcaacaacatggatggaactggaggacattatgctaactgaaataagccaggcacagaatgatgaataccaactgatctcacctatatgtacaatctaaaaagtcagtgtcatagaaacagagtagaaaggtagttaccagaggttggtggagagagggaaggagaaagggtagaaaatttcaggtagactgaaggaataggttttagtgatctattatgctctgctctatggtgaccacagttaataataatgtatgtatactttaaaattgctaatagattgttaacattctcaccataaaaaaatgatgtgaggtgatggatatgtcaattagcttgatttactctttctacaatgtatgcctagatcaaaacatcacattgtatcccacatatatacacaattattatttgtcagttaaacataaactttattaggctgggcgtggtggctcatgcctgtaatcccagcactttgggaggctgaggtggacggatcacctaaggtcaggagtttgagaccagcctggccaacatggcgaaaccccgtctctactaaaaatacaaaaaaattagcctggcatggtggcgcgagcctgtgatcccagctactggggaggctgaggctggagaatcacttgaacctgggaggtggaggttgcggtgaactgagatcatgccattgcactgcagcctgggggccagagtgagacttcatctcaaaaataaataaactttattttatttatttttgagacagaatctcgttctgtcactcaggctagagtgcagtggctcactgcaacctctacctcctaggttcaggtgattctcctgcctcaaccttccaagtaactgggattacacaggcgcctgccaccacacctagctaatttttctatttttagtagagatgggtttcacttgctggccaggctattctcgaactcctgagctcaagtgatctgcccactttggcttcccaaagtgttgggattacaagcgtgagccaccgcacctggccagttgaaaataaactttaagatgtatgaattaaaaaaaaaaatcctatccatctggtgaggggtcataattatttttaaaaaaagtcttcgcgagatttgatgagcttcccgattggtgaacatattgaggtgctgagacggtggtgcacccaaagaaggcctagaagcttcatgcatattctgcatattcctcgcccctgccctagtcctgctgcaaccttacactgtgtacctgttccatgtcgctgctcctgagttgtatcctttataataaaccagagttattatgtttccttgagttctgtgagtcattctagcaaattatcaaacatgaagaggggttgtaggatttatagttgcttagtcagtttgaggcctagacttatgattggcctctgaagtaggaggagtctgatgtaactaaacactttaactcttgcgatctgatgttaactttaggtagataaatcttagaattgaattaaattgtagaaccgtcagctggtgtttggagaactggagaatttgctggtgttaaaaaacatataataataataataatgaattatgcttttacagcatgatttcagagacagctgaattgtctaatgcaccgagagtgactagaaggcaatagcactgtatgaatgcttattctccctcatgcctccccagccacttcaatgatctggcctaattccagtggcccacctccttgctccaacattaaggtccattgcaaatttgtaggtgtgtgtgacattttacccttaagaagcatcttttcaacaggactgatatgggtatcctgtaatctggttctatttcatgtgttttctaagttttctttaattgaagaaatgagaaagagggatatatttttgcagtcacagctcatgtaagtaactctgctaaacagtaggttgtgtgatggcctcagggccccctgtccccttgctcctttaccaaaattaacagtgtgccatggactttcatacagtttcttatttgacactcacattagccttgggaggacatttcaactagacatattatcactattttccaaatgagagaatggaatctcagaaagacagactacagtaaaagaatcaaagcatattaaacctggagggcatttgggagatcatgtggcaaaatccctccattttatgaagggaaaatgaagcctggatcaggaagtgatttgcccaaagccacatggtcactggtagaactgggttaaaaacccatttgtcttcttactttggtactttctcctttggttatatcatctaggcccccagtgcagattttcttcatagcaaatctagggtttaccatcccccgtccctgccaataccactgtctgtaaaatatagactcctcctcaagttagtttccctcctgttgaggcaaagattggaaaagtgtaattagaccaacaacactcagctttattaatgagcctttcaagatgctgcctgcttcccatgtgtgggactggaccaaatgggacagttgcccaataagagcccaaggaaagaagaatgtgagggatgagtcaatcctgggcatgtgcttactcaacctagactagcacatgtagttggtgggagaacttgaactgtgacagggaggatcaaggttacagctaaaaattagcgctgaatgtcaagttcaaaaggtgaggctagggatgaaattggaggatgaatcatgaagttgaagccaaaaggttcaagaaaaggatggattccgtatgagaaacgtggttcagaacctaggatgtgaacacttggtaagtgctactggtgcctgggattggtgcctgggatgtggtgatgggtaccatgcaggacaagacggcatctactgagtgctcccgcagatatcatctatgggaaagacacacactttagggaaataacattgtataatatcaaggaatgacatacatatggtctctggggaagctttttgaaactcagttcatctttcctttgatggggaaaaagcagaattagactgaaatcttttttagcctacttgtcattcagatagcatgcttgctgacccttttatctttgccgaaatcagaatccttcatgtctgctgcatgcgctgtgcaatgctatctggacttcagtgtgaagctgtttttcccctctgccctcttttccatctgtcctcacatttctgagtacagattaaaagccttgcactcattagctggggcaccactgcagccagccagcccatgtttactgggtgcccatggggtacctggcattgccctgggcacctgcgagagaagccaagggctctgacatcccttgccctgggttctggctcccaacggtgctgcagggcagatgaacaggcctgacaaatagtaatcaggaggatgaggggggactggaagtttggaattttgagggggctggagaggaatgaggttttggatagaattagaaagtgtgagattcagtaaacagttattttaaatgaaagaaagaacttccagcaagtgcagtttctattactgtccttgcagagtggcagacacacccattctcatgaattctgtaatggatggaatatgaaatattgccaaaataagtgacattccttggttgggagatgtattgaggctatttggttctgcctgcttatttcctgcttaaggaaacttttccatatatgtgcttaggagggtctagttgggatatgcactttcaaataacctgaatgttcagaatgggctcactataaacaccggcagttgccaacaaaagtataagatgggctagaatttccatgctttggatgaggtaaaagaggcccaaccacttctgaatgaaaagttattcctcactctgtctttgcttaataaaactgcactcactctgaacttcagaaatcaaaagcagctttgatttgttggggtggaaaacggtgggtaaatttttcctttttttaaattttgttttctcagaatatcattatgatatctgtgcaatgtggaaaaacaattatctgctctctaaagagatgaaggtttgcaactgaaaatacaatgtaaaagagagtatttctcttcctgacttgagaatgaaactaaaccatgcctatccctgaagacccagggaaaattccattccttccatgcaattcccctcttaaatatctttgtgcttccccagggcgcagcacattggtgtgagtctactggccgctcagtaaatacctgaagataaagggcatagtaatagctaatgtagtcataacagttttcactgttgagtgcctacaaggagccagctctggtaggagcagttttatggtcctcaacagtcaccatatgcattccttataatgagccagcaaaaaaggaattatatccaatttcacaaatagtcagcctgagactcgaagaggtgaagtctaaggccacacaatcagtaaatgacaggactgtaatctgattccaaagcccctgctccatgtagatatctcagtggcttctgcacaggacaggacacaagttgctgtgaccagctggtgtgcttctctttatttgcacctggacaggccaaggattgatgagtgggccggagcccctttgaaaatagcttttgaataacccatatgagaaaggaccagtaagttggcttggtttcttggttttctcattgctgtcggcttgaactttaatagaatgcacaccttcctcttttttagtttcactaaatgtcaaggttacatcagcgtgagccacttacttttcagggagggaagtgtgtaccactagtggcccagcatatcaacaaggcaaggaaagctttcccagtaaccctctctgtggcagggccagcagtgcagccctcttgggtgtctccacacatccctaggatgtgggagagggcaaagggaggtacccagtggccacttgctggctgattgataaagaatgatttttggtttctctctccttctccagcatcctgggggggtgtgtcagctcactgagagagaccctttttctcttgagatttctctgccctttctctgcacccatcccacatgcttgtttctcaggcttgagtagaaggcagatgttcacagtcagctgtaatgggccctgggcttgctctttatacatatatgtgtgcacttgtgcattcattatttattgagtgcctactctatgctggacactgtgttctaagcgagacaggaaccctgaactgtcttgggggtgggaagaccctctaggtacaaaaaaatgtgaagtgtaatgagaacacacttacacattctgccagagccccaaagagtcattcacctgtcggggagtgaaagtagtgatgctggtggggttggagaagtcttcatagctcaggtgcacatttaaactgaatcttgaaagagaagtaggatttgataggcaaacagggcaggaggatggagcgttctgggcagatgaatgcctatgcaaaggcctggataaacgtggttttcagagaagaaactgggaaatactcattctctgtttatgtaaatgtgatgcctcctttaagtccagcacgagtcccactttctctgagaggctgatctacactattccaggtaaccccttgctctccttttaaaataatcctgatgttggtcaaaggattcaaaatttcagtttagataggaggaataagttcaagagatctattgtataacacagtgactgtagttaataacaacatactgcactgtatacttcaaagttgctgagcgagtagatttttaagtattctcaccacaagaaaacgataagtgtgcaagatgatgtacgtgttaattagactgatttaacccatccacaaaataagcatatttcaaaacatgttatacaccaaaaataaatacattttaaatttgccagttgaaaatttttaaaatatatataaaaaaatctgtagcattatctgtctatacttaatcaactaggccttgtgttgttacttaactctccaatggatatctattttttccccttaactatactggtagcctttggaaagcacagagcatattctatatatattctgttcccctactatgacaagcatagaacagagtacttaaaaatatttaacatgtatctagaatgagccagaaaaagactttagagatttttcagagaactgccctcatttgacaaacaagaggctcagaaaggggaaatgaactttaatgaaatcatttggtggcacaggtgggatcagaactcaggtcttctgattctcagttagtggcctgctggtttcatcagctgcttccctgtttgttgtaggcagctggatagatggacatcatgggtgtgtgatgcatgtcaattgcagccttgtctcaatgccacccactcttcagctatttgctaaacctcttcatctctctccctgttgcctccacaccatcttgggggaggcaagtttgtattttcaaaagtggagactcctcagcaatggactatctcctaccagagccttctgaggacacctttcacagagcagttggcatttgtcgggggtgaggaggaagggagtggagaggatgtaatctcctgctttcacttttaattcttcaggaggaaaggtcttccccccatctctgatgagtgttttcagagtaataatcacctgtggagtaggaggggtatcccacacatttttaatgaacccagattaatgagatgtcaccaagacgatttttttttttactttaaaatgaagtttcttttgtctcagagcctttgattcagaagatctttatgaacagagatggctccatgtgagtgatgcccagaaatgccttgatcacatacagtggctcatgtgggtcctgggctaagctgtcactttttacagctatgcctcaggaagtgggcagtccttctcctattctaaaaatcaaaataggataataatgatatttccttacatttgtaaatagcaacttgcaaagtactttgagtttgataaagcactttaaatgcttcattaatttttttaaagatgctatcactgattttacttcatgtccatcctatttatttatcaaatatttattgagtgcctattatgattctaaacattaggaacacagcagtgaaaaaagacagacgatgcccctgttattgcagaactttcttttttaaaaataaaagacttttgcagaactttttttttttaaagacttaaaaaaatttttttaaggacggggtctcactgtcacctatgctggaatgcagtggcatgatcatagttcactgcagccttgaacacttgggctcaagcaatcttcccacctcagtcccttgagtagctgagactacaggtgcatgccaccacacccagctaattttttgttgttgttgtttggtagagacaaggtcttgctatgttacctaggctggtcttgaactcctgggctcaagtgatccctgccttagcctccaaaatttctgggattataggtgtaagccactgtgccagacctttaaatactttttattttgaaataattttgatctgtagaagagttaagatagtacaggaagtttgcatataactttcatccatcttcccttaactttttttttttattgaaactaagaagttaacattggcacaacactatgaactaaattagagactatgttcagtttctactactttttctactactgtcctttttctgttgcaggatataatccaggatctcacatacaattagttgtcatctctattcagtctcctccaatctgtgatagatcctcagtctttccttgcttttcacgatcttcacacttttgacgggtacttatcagatattttgtagaatgtccctcagtttatgtttgtctgatgctctcttacaattattctgggcttatggatttttggatacatatcacaggggaaagtgcccttctcttcgcatcagaggtacccaatatccacaagacgtccctggtgcagttagctttgatcacttggcccaggtggtgtctgccaggttccttctctgtgaagatattattttccatttgcttttctttggaaggaagttactaagtcctgcccaccacactgaagaggaggggaattagcagagcttgcttttaagtaaaaggagatagaaaataatggagtaaataaacatgaaaaattatcaatgaatgatcagttttgagcagagaatcaaaactaagtgatgtgattgtgagtgactgggtggttagggacagtttcagctgatatccaaataataaggagttggccatgaaaagaccagggggaggagcatgctagagagagggaacagcttccagtgcaggagcaaacttggcatgatcagaccatgcctctccccttttcaaaaccctccagtgactcccgttccaccagagggaaagccacagtcccaacactggcccacacaatctgcacaatctgtcccccatttgacctctagccccaccctacaccttgctattcctcaaacacaccaagcacactccacacttaggccttggtgctggcagctccttatggagaaactgttctcctttttacgctcatggtcatctccctcacttctctaaggttttattcaatgtcatcttttcagatgcttaaacttttttgtgtgtgtgtgtgtatcaccacacacacatgcacacacacaaacaaacacacagtgagtgagtaggtgccccagtccctagaagtattggcacgtgggttagagggaagcccactgcatatggacttttcatatgggcttggaaactttcttaagctaactgggcatgcttgaaaagccaataggcaactgtgactctttagcacccatctccttaaggttgtttttttctgacagttatcactgccaagttgacaagcaatcaattcctttgctccacgctttagacactgcctaaatttcaggtattagcaaattcttctgctccctcttcatttgctggtgactaaagaggcatatgcatcatgcctcctaccagctggcatgagttatatgatatcatatagtttctactaaacctcatacatctctgctttctctaatgaggtggatgtggatattgaggttgcatttcttttcagagaaaataaaaggcaagtcaatccatgtggtcagataaagggaaataagtcttgaataggaatctctcctaaatggccaatgaatcagcatagaaaatgcatcagtgaggcctaagttagtaccacaataattctcattttacagatgagtaaactgaggcagggagtggtaaataactttcctaaggctagtaccaggagcagagccaagagtcaagtctaagcaatctggatgtacccacaatcctctagcagtggctccagtgtggaggactcctattgtagacagtgccttctcctagcacaacatcagcaaagaaagactgtaaatatctccttactagaatggaagctccctgagggcaagaattatgaattactcataattgaacctagagattggcaaaataattcacacagtaggaactcaaataggtatctgtgaggaattaatattattcattatacagagttttggattattcattattttggattagtcattcttctgtttctttgatgaggaaggcatcagagacactggtcagactgtaatgtaggaatctattttccttagttggattccttttctacactttttgggcattatttcctcatagaaatgttttgtaaatgtggccagaaaatcaacagggacttaagggaggttaaaggaattaacatgtgtttgcaataaagcgagtcatgctatagctaagaaagtagtggttttgtaaattaaaccctgaccccagctctgaactcaagcaaacattctttttcctttagaaaagaaatcaaatacatgccagtatgaaaaaaatgcatcttccatattaaaggtccactgtaactaaacttttaattaaaatgagcacaaaaattaaataatataacctgcaatgttgatgaagcttagcctctgtgcaagaaagctatgtgtttctaacctgttgacatttttcaaaacattaataatgggaaaactatcccagtggggatatctcagacttaaatattcaaaaggtttttggaaagtgtcctacatctgggactgttaaaaagataagtcaacacagggataaaaaaaaaaaaaagtgcttgggttgttttagtaccttggaaaggaccgatactaaatagagttgttatagaccaatctcctttgcccggataagacggtccctgactgggtgtggatgacagggagctagaaagattggctgaacatgatggtgcacacctaacaggctccatatcaagaaagggaaatggggccaggcacagtggcttatgcctgtaatcccagcactttgggaggccaaggtgggtagatcatgaggtcaagagatggagaccatcgtggccaacatggtgaaaccccatctctactaaaaatacaaaaattagctgggcatggtggcatgtgcctgtagtttcagctactctggaggctgaggcaggagaatcacttgaacccgggaggtggaggttgcagtgagccgagattgtaccactgcactccagcctggcgacaggacgagactccgtctcaagaaaaaaagaaagggaaatggattctggtcaatgagtaatctggaacaatataaacaattctttttgctctgagttctagaaactgacagggagacaagagatgtggacatatctgatggacaattatgttagaaaacttcctttggtggtggggggagtccttgttttaactattctgtccctatgttagaccacatacctaaagtccgcatttttaaaatctatgacatctcatcagcctactactggaaaagacacagaggaaaggggctggtaaaaaaaaaaaaaaaaaaaagatttatttatttatttattttgagacagggtctcactctgttgccgaggctggagtatggtggcaagatcttggcttgttacaacctccacctcctggattcaagcaattcttgtgcctcagcctcccgagtagctgggattacagacacccaccaccacaccgggctaattgtatttttagtagagacagggtttcaacatgttggccaggctggtctcgaactcctggcctcaagtgatttgcctgcctcagcctcccaaagtgctagcactctgtgccagatccagtgctaaggttatctcatactaactcattttatcccaacaacagccctttgaggttgacatcattattattattattaccattcttctcactcaggaagagcctagataacttatcagaaggcacacagtaggtggtagagctgtcattcaaatgtgcttgcttgaagctaatgttaacgcctgagcaactcatctgagcccaccctgtgatttttacattgactggcagaaacgaaggagagggagaacaatgttagcagccaggaagatgagtcacatggctgtgatgtgccactgagtccctgtgatgaggaagactgttgtgacactcaattacaagatgctaaattctttgagtgtacattatggattgcttatagttattctttctattaatgggtgacactcctgtttgtctgggatgcttttatcctatttcagttatgttcatgcttctctttcaagatccggcttatgtcagaaagccttctccatccccctaatttgagtcggatgtgtcaacagcacttgagcttgtgaattttgtcaggctgatctgaatagaactgtctatcttcccactgtggcagacatcttttagggtgtctgcataaccgacagtgtctgccttcaccagataactgttctccccaccatacaggcaggtaaccaagacctatttatctacctcatcccacatggatagctgattgggtcagagaggacatcagatcctctcggggaaaaccaaatttcttctttggagaatgtggaattgggataaagagccagacagctagtcagtacaagaaggtcttgcgccaaaggaacataaacttgggagctgaagtgggaccatttctgccctctatatacacagaaaataaaaaataaaaaaaagacagctcatggggagaattgagaataaggccgtcatgcagagatgggcaatggagtaggagtgagtccctggcttataaccttgtttcagttttggcttccagttccttcatttgtccagttacccttgagttctatgacatatcccaaaggtattctagtaaatcccccttttagtttaaccccatttgagtgcgtttctgttacttgccccccaaagcactttacctaagatgccgtcaggaactagagcccccagaggacagtggcaggatttgttcttgggtgcagccctaaggtagcacagttcctggcttagttatatgaatttttgttgaattttactaacttaatatagcttttctatgagatagcaataacactacctggtcctccccaaattgccacacgctccagggaattagatgaattaaagccaagggctggctggctccattgaaagccacgcttcgcctcactgttgttccgtctcgtttccagtttgagaaggcagggaggctgggaagctgaaaagcactcagaagacagggaacagcaggagaaagtgacaagcgagacaggatttgaaaggggcttgttttgagtgctttggaatcaacttgttctttaattaagggggaaatatcaccctccagctagtaaagacacccctaagaaaattaaaataatgtaaatcaagctaaatgaatactccagaagcggcactagagctttgtaggattgagtgtttggatgcccctgaggttttaaaagcaaagcttgcaactgctttttggagcagaaacattctctcttttgtttgatggcaaaggaggctaaatgccgacaccaataggattcacggaggagttggaggtgacagaatcttcttactgtttcggctctctaaagaccagaattgaaacaaaacctaagtagatgatgctgataaattcctggggttgcttcctaggggtgttcaatgcaaagaaatcatttaacttgtaattaattctacaaagcaaaatggttcaaggggaacctagagtttctagtaaaataccttattaatcacaggggcgttttacctgggaggtgcaaaatgactgaggtgtgatggggtttgtgtgtgtgaaagctactagtatggtagtggcaggagcaggaggttcaatattgcgacaagaaaaggtcgcagatccaagtgagcagaacaatctgagctttactttttcatcaaatgtcttaatttcccaagattttaccttaaaggaggtatgaggatggttacaaagtgtgtactcaatctttggttggggggggggggttccaatgtaacacaaataatttattacacatcaatgtttctgactctcaagatagcatcatgactccttaatcaatggtttatacgtgatggcaaacttgtgcaagaagattttacttccataggcctcttggtgctggaagagctactctagtcctttcatttctggatgaaggaaaagagatctagagagattaagtggcttgccaaaggtcacctagtcgtagggtgagcatatgattcattgtgcaaactggaggacttttgaaggtgaaaggatgtactataatattacagttataccaggacttaactggtgtcagactggactgttcgggcaaggcagggcaggtgatcatcctatttagacagctcagggctttgcttcaaactcacaaggaatgaggaatattctatttgcgggtcttctttgcaataataaactgccatctgggggcagggaagggcaccacctggaggccaggaatgggagggcgattccttgcaggacctcaggctgatgggttttctccacaattaagtgtggttagtaggggcttgactgtcttctgcaggcctgagtgaatgtcttagtccattcatcagaatatctgagatggggtaatttataaagagcagaaatttatttttcaccgttctggaggatggggagtccaagatcaacacaccagcaggctcagttctctggtggaggctgcatcctctggaggggaggaatgctgtgtcatcccatggcggaaggcaaaagggaaagaaggaggaggctttttctcctggcagccttacagcaggatgccttgacactgataagaaaacagcattagaagggcccttaacccatcttcttagaataagggtttcaggaaccaactcacaactgctcatgtaatttttaagaatttcaccttctgcatgggtgctactctggattcttgttagatatggatggaggatagaaatgctgaccctgtatatatgcaatgtggaatattacacagccataaaaaagaacagaatcatgtcttttgcagtaacatggatgcagctggaggccattatcctaagtgaattaatgtaggaacagaaaatcaaatactgcctgttctcactcataagtgggagctaaacgttgggtactcaatggcaccgacagacactgaggactactggaggggcagggagagagggaagcaagcgttgaagaactgactgatgggtactatgctcagtacctgggtgatgggatcatctgtatcccaaacctcagcatcgcgagatatacccaagcaacaaacacgaacatgtaccccccaccccgaatctaaaataaaagttgaaattatttggaaaaaaatgtgaaccacagatgatgcagcttgaagaagcatgtcattgctaataaaaacaaccatttttgagcactcattctgtgcaaacaactattctgagcactttttatacattgatccccttaatccataaaactactctgcaaagtgaaactgttctgtctcctgattgtgctgatggtcatccaaatctatatacctgttaaacttcagagaactttatgccaaaataaaaaagttaattctactgtataacttaaaaaacaaagtaaaaaaaaaaagactatatactgtataagtccacggattgaaatccaggaaaggcaaaactctagtgattgcaaatcagtgattgccggggctagggtaggagggaaggactacagaagaacacagaaactttttgggttgatggaagcgttctagaccattttggtcatggttacacaactatgtatttgtgaaaaagcatcatattgtacagtttaaattcttaaattttttttgtatgcaaaccatacctcaacaaaactgggggaaaccaccctgtagaatggacatcactcatatttgtcccattaatgaggaaattggggcacaaggaggttgaataaattgcctagggtcacagctgatagagccaggattcaaacacaggaatgaataattccatcaattttcacttccacaattaacagctgctcatgcaagtaggtcatggcccttaacctgggtcatgggaacacattagccctagagaggcagctgcaacaggtagaaaatgcttgacccccacagaggactttacagaaacagcagctgttccgggatgaccatttgagtccacacacaattagtctttcccaaagcagacacaattacttgatttgaaaaactggtgccaggatgctaagtcctgatgcagatatctggtggcccctgggccttcccctttttcctggctgggagtgtgatttaaaacctcctggctaagctcattttgccaaatagctcctgcaggattcatttccaaggctgagtccagaaatttctagctcagcaaatagatccaaagcaagatgacgaattcacccaagctacctctgagactaaggaatatggtttcttgtgctttgcagaggcaaacagatgtgtttatacacaaatttacacacataaaatgccttgcttgttataaagaagagagaaaaaatgtaactgtacatctgcatgtacagtagcttccatctgggaactgtaacttcccagtagctgtccatctgggaggagaaggtgaatgaaggaatgaaggtcctccgcaggaacacagaatgatgctgtgtcatatttcacaccgctgctgtactacttggagaaataggctcctgtctcactttacagctagaaacagtgcagactgttcttaaggctgatgcagaattgagaggaactggaagatcatctcaggtaacacaatcaggcacttatgattagaagaatggacttacccaggatcaagcagctacttagtggcagagccagagaggtaaggtgactgtctaaggtcactcagtgcatagctggagtcagagacctgggttctcttccctggaccaaccatgcaactgaaagcaggttctttaacctctcgaggtttctgttccttgaatataaaatggtgctaataagtgctagctcaaaagcttattgtgaggactgggtgtgataaggccctaagcacaatgcctgagacacagtacatgctcaataaattacagctgatggtagaagtcattttagttcaccgtggttatgctaatgtatcttatcttcagtttgggctagatgagttctaaggtgaaccttagaacttagttattggctagccaataactaactgacttgtacagcactttatggcttaaaaagccctatcacagaagagttttctttgcattgcacaattaccctataatatatatatagaaccagcacaattagctccatctcccagtttaagagactcaaaaagccaaagcagtttactgaattctgccttttccaagatcacacagccaataagtggcagagaggagtgctgaagtcagatcttctaagtcaaaatgttgccttctgtctggtggcccaagtgtccaactcttaggccattgtccttcccttagtgtgtttgtccctgcttccctacagccccccttccaggccaagccaaccattgctcttggagtgtgcctctcaccagcagatccaatgaataatcatgacagtaaccctactgttgcccttttactgcagagatggggatagatttatagaggctgactgtggctggtatttgggaatggataatcaccttcacttactatatcctaggctgcttcggctaaatatttactgcccagaattctgccctttccaaccaattctgaatatgagcatggcacaggcaactaagtggcataattcatttggggcaaccataaatctaaggcttccaccagaaatgatgcaaaaaattaatggaacatgaaatcaagtaaatggaattgagtacagtaattagttcatattttaatcctcaggtctgtttattatctgtcaactggcgagcaattaagttggcaccattgaaatgattagctttgtttcagcaaaagtttatcgatatgtcagtgcaaatggatccggtggttttaaatggccttattttgaattgtagagcagcacatccatggagcagctagacatcgaatgatttaatttagcaatattatctggattacttatatttaatattactgaactgttctggagggttatgggggaatgtgggcgggggagatttaaactgcacaaaagcattgcttctgttcttaggttcttaatgcaatagtatgattgccttttcatattgagaccaaggaagaacatttaagacactatattttagtcttccaatctttaattctcacatttatctcaatcaggcactattatggctcgctctcacattggtggtcttttctcaggggtgatttggtgatttctagatccacttccttgtggatgctcatcatggcttatgttttgtgaaataatctcccaatgtctttgctgttttgaggctgactctatagatgcccttgcgatggggctgtgctcacaaatgcaggaaatgtgattctcaggctctatttgctctatgaggtgactaaaccaggtgacctaagaaggttttttgaatcttgggatttgacagaattctaaattttatttaaaaagttaaaaatccccaattaagagtcaggaaacttgggttctggtcctaattctgccgctaaatctctgtgaccttgggcaggtctcttgccctttctggcatttgatttttcctttgtacacacagggggtatgctggaagagatggcctcaaaagttcctcctctgacactgtcactttagatggacacttggagtagacttgtcctttccaagtccaggtctatgtctggaagtgagagatgtgacctttcgtggaacctctacaaattttcattggccactgatagtatcagagtcccaacgaatataggtcattcttatttaacacctctttttcaaattgattttattcctgcagcgttggaaatgagttaaaaaacacagctagttcacggaaatgttgtgagcggtactcatgcctgtaactgcagtgtcactggttactaaataaacgaaggcctcattcaacacttgtaaaatgataatagccatggtctccatggtgacaggtctgaggcagaaccctgatcaaattccagttaatgcctgtctttaatattgtcttttgtaatgtaacaccttcctcctttcttccgatgaagcatcagcagggagatcagagtcaagtggaggaggatggtggctgtcatatgccatcctgggggtccaggccagagttatgatgcagattaggctggagtcaatgggataatgagttgaccgcaggaggctgtcttctaatgcaatgccctctctcttaggctgcactagtgactatccaatactggcaattcaggaactgctgacttgattgggctgtgctttcccagaagtaattataaaaatgtccagagggagaacttcctctccttagatcagagtcatcatatgcttgctggtattgctgtaatgtgccctaccaccatctgagcttctgcctctgctttgcttctcgaaggccagtttgctcactctggtgggactggctcttagaatctagaaatttgatgtctagcattggcaaagctccttagtctgatcctaggagtaattccagggctgaaatgaggaatctaaatgaatttttctggtacacaggttctcaattgttccattatttctcccaggtactccgaatttacttaccttgtatttgtgaataatttaacataaaaaattctagaacctctgttaatattgacaactttattaggtttgccattatgactatacaatttaattcatgatctattgggtataatctaggtactttgaaagctacattcttaaattatcttcatttactcatttaatctctactcagcaatacgtaccctgtgcccattatgtgtatggggagatatttaaaaactacaacatactctgtgactgtagggagttaacagtctgattggaaagacaggatcctctactatactgtaggctccttacaggtaggcactatggcctatcagtctttgaatttccctaccaagctagggcccagagcagatgcgtaatcattcgtattgggtttatggataaattgtgggctatattaggcagtgttatgaatcagaagacccgaactaagtccaatcttggttatttattgcctggatggtcttgggcctttgtttccccaagaaggtggtaacattgagagcaaccgccttgaggtttatgatcaaatgggagaatttctgtctctgtgctttggaatttattcagagtaaaaaccaaagtccatacaaagtgcacatagagaggacccacgtggtctgcagcagcctctggccctgctctgacctctccgacctccttccccatcactcacacatgtgctcatgctgcttccgctcttccttgcatgctcacagctccctcccacttcaaaatcatggtactggcgattgcctctgcctggaatgtccttccccagacatctccctggcaacctcacaaatgtcatcttctcactgaggcctatactggccacactatttaaacttgtagctcactccttccactcctcattctctgatctctcttgttttgctctagttctctctccatagcatttatcatattctaaatttacatgtaaatttactcatttattatgtttattatttattatctgtctccccccgctagactataagcaccttacaggtagacatttttatttgttttattcactgtagcacataatagacaatcaatatttgttaactggatgaatgaatgaaggtaaaccacaaagcatgtgaacagtggccaagtgttggcagtgagattctgcagccacctatgggcatgactgggtgagctctagattgtgctgcacagtaactaactcaagtctgtgccttgtccttccagtggctcttaaatccctccagggtagcgcttaattgttcaatccttttgtgtcctttaccacatttgggatagggctaggtggggtgccttctaaatacattttgaatttctgaaagcatatttctttcccagagaaattccagaacatgtcttagtagtaactgcaaactgaaccactcttcctcttttacagtttctaatggaatttaatgctttgggtagccttcatataaacactccatcttcaagttaaatggggctgtatatttctgtatagtgaatggaggcaacatactttagaatttcagggaaaaaaatgcctataagatttttgttcctgggacacaaatggttgactgagttgttgattcagtggtttaatgactcattccacaaacaccacttaagcactgactgtatgtcaggcactgtgctaggtgcatggcatgcaaagatgaataggtcttgtccttaagaggtttaccaaggtcatttattccctcattcagtaaatatttattgactatcctcaagtccagacaatgtatgaggtgttgggaacacagcaatgatcaatataaaattcccatcaacaaaggactatggttccaatagaagtgagattaaacagttacaaaacccacagtgatgggcaacataatagattggggtcagctaaaaaggccaggtagtaaatattttggcttctgcaagctgcatgtggtcggtcagtttctctctttttaatagcatcctttaaaaatgtaaaccattcttagctcctaggctggacttggtccacagggtatggtttgtaaacccctgtaatagatgaatacacaggatcctctggaagtcaaaaggaggcagcaccttcctgtctgggaggagagaaaggggcttgggaagctatgatggggaactgtggtggatgggggaagggagatggggctggcattcagagtagagggagcagcttcaccatggcatataagtagcacttccatatgtattgtccatgtacctgtccttatacatcccaatcctcatttcctctcaatctccaattgtgtcaatggagcatctctaccaggaggtcgtggcagagcagcaaagtgctaattacattgcctgagcactcctcacaagccattcattgcctaatggggccctggctctcaaggatgttctcctcagcacttttcataccctagcacacttcaggacaatttgatgttagttgcttattcctacaaatttgtgttgctttagtgaaaccagcctctcaaggatgcaaataattgattcctggaagaggacaaggcctgcattttctgttgttttgtttcagttgttggttctgagataattgttttctcttttctgattcagagccactgagagagagagagaaagcaagagagaaagccccatattttacatatgactttaattctccccttttaatgaaacacatcctatctatatcaccatagcaacagctatggacttttccctctctcagatgtgttttgagcaggatcagagattccagaggctgagagctagcaaggtcaaggtgtttctatcttgctgtcagagggagcagcaagtgggtcaggttgcacagctgctcacccattctttgcttaatgctatctagtgagagctatttcataatccccttctggaataagcttcaaatataatccacattatgtggtattatcaatatacatccctcaatagactttacacatctgtgggcagaagctgcactctggcccatgcctagctcggagcccaccacatggcagaagcacaagagcatgtgaagagtggatgaaattaacaggaggaactggctatagatcttgcatgaagtggctggtacaattctccgtgtacccttctgcccccttgaaaagaagaacttaaggaaggatttttaaatgaacttgtctaatgtatcccaaatcaggaagattcttcttgtccagcccccactactgcaatggaatctaaggcatgtttcttttcaaatattattttttccctggctaatgtattttcttcttttcataaatatcctactttatactggacattaatctaaccatttagacatgattagcaagctaagggtcttacttattaaaaacagttcatttttccttcttaaagaaatggagacatttgaatccctgaatgtgctcatttatcaccaatccccaacaaggaatccaggagttctctgtgtaggacatgagtaatttttataaaaatgcagttgctgactatgtcatacatccatgcagctttataaaacaaagcaaatgattaccatcaattacaataacctcactagacaagactgcaattaatctatagctcttcagataacgactgttgcactgtgccaaggaaaatgcctggcattaattgacttatcacgatcagcagtgatagatagggcagatggcaatgtgatcattcactgtcaacaaaataaacacatgctttcttgctagaagtgtctacttgggtcctctcaaaggatagccaaaaatagaggccaaaggtggctttgaaggtagcacaaaataaaaattaagttaaccagattcgcgcaatctacccacataacaaacctgcatgtgtacactttaatctataataaaagttgaaattcattttttaaaaagttaaccttcagggtgagatatgttgacttttactgaggctaatcctcagtagaatacaattgaaggaaatttctataagaaaatcatggattggtgcagtggctcacgcctgtaatctcagcacttcgggaggccgaggtgggcagatcacttgaggtcaggaattcaagaccagcctggccaacatagtgaaacctcacctgtactgaaaaaaattagccaggtgtggtggtgcacacctgtaatcccagctactagagaggctgaggtaggagaatcgcttgaacccaggaggtggaggttgcagtgaaccgagatcatggcactgcacttcagcctgggtgacacagcgagactccatctcaaaaaaaaaaaaaaaattatggattgtatagaatttcagcatcagaagatacattaaaactgacagtttcccctgctcattcgaatgtgagtcacctttatggagtcaccaaattctgttcagtgcttaataactccagtaatggggctgagtgcagtggatcacacctataatcctagcactttgtgggggggccaagacaaaagaattgattgagcccaggagttagaggttacagtgaactgtgatggtgctaccactgtacttcagcctgggtaacagagtaagaccctttctctctaaataaataaataaataaataaaataattccagtaatatgaagtcacaattttcagaggcaaactcatttcatcactgtatcgttttcatcgttagaacacatatgcagctgaattccatctttttgtagctaccacccattggccataggtgtcttcccttatgctacacagaagatgccaaactcttcttgcttgctgaaatccgtaaatgggatctcaaaagtcaactgcttatcgcactactttgcatatagcattgtttcggggactctgaaattctggtctcttgcacctaaacccataccagttcgtctatagacccctgacattgagaggcttggaaagaaatgtgatacgatgactgcatctacccagggcaaggtagattatacctatgctgaggccagtgctcaagcctacattggagcagtggatgtgtgtgtgtgaccaccctacttgggaagctgttctccaagtctcattagtctagatagcatcccagccttgccatttccaggggacaattaccaatgtgtgtgccttcccccctttttagcagtgtgattttgttgattaagtcccctttgtttagaaaactgggataattcaggcggagtttcacctaaaattgtcacagtggtcgctaaccaaaatctcttggggaaagttttacaaatgtacaaacctggatcctatatcctgagactgattcagttggttttgggaaggactgagaggaaaatattttgacaaggcttcccagttcattgtgatttgcaaccctgcttacatgctttcttcactcattgctttcttcactgggaacacataataatgtaccattgtggaagtgcttcacaaacctaatcgtcagactctcctgggaacttttaaaatgcaaattctttggtgcacctgatacctgtggtctggtgtaggtctaggaaaattcatacactaagagatcaaattactatatgtttcccttaaggattttggaagcactcatttactctaaaattgtggttcacgtataagttacaaagcacccttatcatatactgaagaaacaagtgtcactaaagaataatacaatgtaaagattttagcctagtaaacatctacattttatcaattattcatttaacaaatatttctactctgaagcagtgttgtgataggtgctggaatatgacagaatatgggggagaaaaagaaataacagcaaacaaaaaaatgagcaagtaagtcaacagataaaataattacaaaccttaaaataacttaagaggaagaattcatctaattttgaatattctctaattcagaccggcagtacccagttatgctcaaattgtgactttctgtcctgctttcattacatttcttgttgtactctagttcagaatctgcaacttgggagcctggcattacaatgcctttggcagacatccctaatcaatcctagtattttttttccctacagatccaggagggagacccatactacagctcaaccctattgtttatagagtcatgattaacagatcacagataaaatgctagatgaaatcatgcagcttctctagcacacactgccctgacatgcctcggggcttttgctcgcactagccctcatttcctgctttgtcattgttgtttatcaatcattgagtactttcagtgtttttacatctggaatcccacttaatttttaaaatggaggtgtctaaactgtgccttagaaggctcaagtaacatcccaagatcacacagtgtgtatcaaagcaagactacaaaactcaggtcactggactccaaagctgatggtcttaaaattgttcatcattgcctctctttacagcccagttcaaggggcaccttctctgtgaagcttctcctgaccccttcaagcaaaatttaccacttcttcctttgagtttgccagggcctttgtacatccccattacagcatgacattatactttaatgacttgaatgtagcactctttgagctcctctgtggtaggagccctttttttaaatctctgtatccctggtaactagctgagtgcctaggcaggctcttagtgacacattttggatgcacattaaaatctggctgctggactcattaagattgtgggtctgtttcttagtgcttggccttaacacactaaaaataaggccagatttatacatgatctttaaaaaaataaaaacaccacatgcaatacatatttttgtaatttcaaagccttcctaacatcagttattgaggactcttaagcagaaacctagtcacagggcatttagcctgtaaggacccctgatctctagttcataaacaccctccagtataacgggggtaaaacagatcaaattacctacaccctacttgtgaagtgtcacaccacagatgacaactgtttaaactgtagctcttgtcctataaatgaaactgtggttgggctctctgctgtggcctgagttctgtctgggttgatggtggcacacagtgacgtttccattttgcagaaactcaggaaaactattgagttgcctgacacttatttcacagtatgttatagttttatgcaaatatgactcattatattcaaaagaaaagttatggaatctgtgctatcatatgtgacacgtgagaggctgatcgcccagataggtgtaagtaaagatgtattatatatataaggtgaggatttggggttgaaataatgctctagaaatatcactggacatgagtctcaagagagctgcaacattgtctcagaaggaaagagctagtttcattgtagccttccctggaaaatactagaagcttgttattgacttcgatgtcaatttgcaaaagacagatggagaaagaaggcatgggccttctcatttcatagattagagcgaatccctttgttatgttatcccatcttggacacaaacaggcacccaatcttataagttgacatttaaccttagtactttgacagactaacatacctccccagagaaggcctgtccattgaggaggtgctccgacccttggctgtcctcactcccaaagtgtagtcggatctcctccagccggtggctgtatgtcatgggccctccagatatgttgaccaagtgctccttgtccaggcgaagggatacgtgtcttccagtgttgtacatggtcccactgacctgcaaggcaattagcaacaggtcaagcaaggccctccttcttctatgcctccccaaacccagcatggtgcttggatcaacaccttttgcttcctcttgatgggaagatgggctaaatccacatgtggagtagggcgtggcagctgccccagagggtatatgtgggatctatggtaatttctgtgaggcataaaccacatgatggcttaggaatttgaggtaagaacttgaaggagacttttcatcatttgtgattaatattttgtgcattgtattttataaaaaatgaatttgtccttcttactataaggatttggaatggaaagatactgcaagagttctaaatctcagctgtgagaaattggagaaagcagttagcaaggggtgagatattaagaaggccaaatgagacagggaagagaaaatgagtgactagaagcagacgctcatgggagatggaaagcctaggtctgaattctcaagcgtcctatctggtgtgtcctgccctgcaaccagacattgcacagaatcctcatagcttgtgggcctcaagtggtaaactaaagggattcactcaaacttccaatttcatagattcctagacttactccttattcctgattccatcttgctccagccccttcaaactgctaacatgactgcttggcattccttttccttcttttcttgctgggacttgatgttcagcttcattttcctgactgtgacctcaacaacaattgattctagaacactcattcccatctgaaactctactttcttactctcttgggttgacttagctctgggagtaggatctagagcttagggagactttgaatgagtctggaaggagtgtttctgggttacaggaggctgaactatttggattttcttcctgcttactctgactttgggccaagccttcagccctagtgattcctgaagggcttcctgtaccttctgacaccttcattagatgtggttttcatatatgtgctctatagcactatcttttacctgcctcttttccacctttctgacactggtgttgtgaatgattagctcttgagttgttcactgtggcagagaccataatgctcaccaaatattccagtgactcattttgtttcctgccaccttactgtagaatggagcccatgtgactgataggggccatgggttgggaggggtcatgacaagtgtcacttccaggttgaaatagtggattccccagactcacctttccctggtacatcgaccaatggcattatatggaaatggcaatgtggtgcagcgactgcatggagctcatgtcagcctaggcccctagagattatgtgcagtttacaaaaatgacaggaattcttcccctccctataactacactcccaacaatgtaattttgtaactgctgtcatctagataagaggctatttctctacgtcgagtctgggctggccttgtcacttactttggccaacagcatgtgctgcacacaacatgctagtcctgagagtagaccttgagggcatgcgtgttttcttcacttcttcgtggagccgtgaaactaccatgcaaatgagcctgggctagcctgctggaggatggggccacagtgaggagagccatcccaggagaggccgtctagacgggctactctgtggctgatccactagctgactggcccagctgagatcagcttagcctggcccaggtcagaaatgtccactgacccataggcttggagctaaatgattatttaagtctctaaattttggggtggtttgttatgcagcaaaagggaactgatagacactaagtcagtcatcttctttctcctgtgaaatctggaactatcaacagaaactctccgttgagttcctgaactgcaaggtcgcctgagtgccaaccatactgttaagcagagaaagtcagatcagagagagaggactgaggcagatgtcccaacattgacagaggagaccacacactggggaacgggggagggaatggggagaataactacttcgcttcagatatctttgtgtctcttcgttctagttccttcaagaggcctgaactgtactttctaatattctacaccttaccaatacatttttaaacctcaagttatctattccttgcaaccaaatgatccatgccaatgacttcactcctgttctccagcctcaaataaatgtatatttagttagtgtgagataatcagaacttttcatttcccataacttccttttcagtacaatagctcaagacagatttgtgttagacgtgacttccatctctaaatataacctattttttctaattattaagataatacataggcattattatatggttcgaaagatatgggacagcaaatcgaccacaatttcacaattaaacaggaatcaccactaatattttggcatatatataattttcacactcatacttatagacccataatttaatgagattttatatatgtgcattataaatatataatatagacttttcacttgcatatatgtatattatatatgactttttatgttattctaacatatagatatttccatgtcattaactattctttagcaatatcactttgaaatatctacatcatatttccttgtaaaaatgtttagctgattgttgaatctttacagccctttcactttttcattattgtaaaaaaaatctgtaataaacatcctcatggataaatcttttcacgaatccagagatatttcattatgcaaattccaggtcaaatagtgtacacattattacagcatttactatgtattgctgcatccatctgctatggggagtagatcccacagagcagggctggatctctgtaattcccttcaaatgacattaagcacagaaccatgggattcaatctagtgacattctgtggtataaaaggcaacaaaaaacattgctccaagttcctatgacatgcatgctttgtgccattgggcaagtatcttgggcttcctaacacttctagaaatcctttcatctatgtctgtctaatgttctcaagaaaattattgcccattgaatcaaggcactgactacattttatgcttgtgtgaattttcccagtacttgggaaacacactggcacaagtaggtggaaaaatcaggggccctggagtcaaaagattctcagtctgcctcttgcgacctagggtagtttactgaatttcttgaagcttcagttttcttaaccatagaggtaacagaatttcctccatgaaaatggcagacaaaaaagctataaggcatattgaaacaaatagcaaaatgacaaagtcccttcttatcagtaattactttaaatgtaaatggattccacttgtatgctatatctaaagtagccaaaatcatagaaacagaaagtagaatcgtgattgccagggactgagggagggaggaagagagagttagtatttaatgagtataaagtttcagttttgcaaaataaaaagagttctggaaacagatggtggtgatggttgtacaacaatatgaatgtacttaacaccattgaattgtacacttaaaatggttaagatggtaaattgtatgtcatatgtattttacaacaataaaaagttggtaaaaattgccctcacgaggttgtgataattaactaatatatgtgatggtcacacgtgttcattctcttccttcccttactcttggctattatggcatgggtgcctaggtgatattgaaggattctcgttgatctttcttccccatgtcttccccaattcccagagcctggtggaatataatgttgcttgctaaatgtcataatgaagaactggagctaacttctgccttgtgatgattcactggcctctcattttggattttaaggtgctagacatgaggagaatgcaagatcatattgaaggccatgaagcaaaccccaaaccagaagcaggaatacaccaatgtgccttctagttcttcgatctcacttccagaccccttctgcatacatggctctgtcttcattcattcattcgcttggccatttactcagaacaaaacattcaatgcacctaacagtgtgctaggagctggggacagtatgactttgaacaaagccagtccctctccctgccatcatggagctcacactccattatggagagacctgaatgggggcacaaagttatgggcaatccataactgctatcattttcctatgtgttcttacaacgagatgcaacacccccttttccccactcttcccatagataccgaaataacattaatttgtattaatcaaaaaaagctgtgtagccagggcatggtttgttgcactttaatttaaaaataaaggcttgacaacgttatgtatgatatctgagggtacatctgcaccgcagtaattaacattgcagcagtgccattttatctcgaatgctaattactgtgttttcaatgaactatttgggtgcgcagcatgttggaaaaagttatattatacagaccaggaaacaaaacagaatggagaagttgaagctgcaggggatatccaggttgcctctggctgcctcacagttctttttgttttaccttaattcactgcaaaataaggtgtgagatgggtgtgatgtccattttaccagcaaaggaagtaagcgggggctggtgaaggttcagtaacttatccagaatcacacagtggcaggtggcaaacccaggtcttctgattccaagactaatgatctcgatgtaagcaaatgcaagtgtccttgctcatttcagattaaaaaaaaatactttggggggccaggtactttggctcatgcctgtaatcctaacattttgggaggtcgaggcaggcggatcacctgaggtcaggggcttgagaccagcctggccaacatggcgaaaccccgtctctactaaaaatacaattagcggggtgtggtagcaggcacctgcagctactcggaaggctgaggcaggagaatcacttgaacccaggaggcagaggttgcagtggctgagatcgcgccactgcactgcagcctgggtgacagagtgagactgcatctcaaaaataaataaataaataaataaaataaaaaacaagtaaataaaaaatatgttggggattttcatttcttctccagtctctatttgcagatcttaggcagttccagaaaaagtgggatctttttcaggaaaagagaggactataattggatgctagcctgctgaagttcatcccaggaggaggcttcgagaaacctgaaggtcaaggaagtccctcaatttcctcacctgcggaattcatactggtttgagactggttggagctacgtatattgagggaagcaggtaataggtgctccacagatgtgcctgtccaggttgtatgtcaatcaatattatcttgataacttgagaccatctagaagcactatgttcttttgcaaagcaaaaattgtatgcctggtgtatttattttgcaaaattagatgtctttgcatagcaaacacagtgctttgcagcagtcagtgatttggggcctctaataaatggggtcatcttttttcattctggtgacactatcatgtttagagggaaataaatttggtcaatgcatttttaaggtaggaaaaattttcattctttgaaattcagccacaatcctgttcataaagatggcatcttggttagaactttactgggtgccacagggggtggcggtaaattctgaacctgaattttctctgttaatcatcacaatttctccctcaccaaacccagcaccatttgcttattctcagtgggaagatattaggctaaacccatatgtggagggaaggcctcccacagggcatacctgtcttacctggtttctatggcactttccatagaagcaaactgccatcagtcgggggccagaacttgacctcagctatctttggctctaaagcctgtgcttttaaccactggaaattattaggttgtgcagtttttgtttctgttttttgatacggagtctcactctgtcgcccaggctggagtgcagtggcgtgatcttggctcactgcaacctccacctcccgggttcaagtgattctccctccacagcctcccaagtagctgggattacaggtacctgccatcacgcccagctaatttttatatttttagtagagacggggtttcaccatgttggccaggctggtctcgaactcctgacctcaggtgatccacctgcctcggcctcccaaagtgctgggattacaggcatgagtcaccactcccagccacagctggttatttaacaatgtaatattacagcattttcttcaagaggtgggttgagagtgtaggagcctcacagtagtttggagctcaggatgtttaggattacttactgtttactcagggttctctagagaaacagaatagtgtgtgtgtgtgtgtgtgtgtgtgtgtgtgtgtgtacatatatatgtataaagacgggtaaaataaagagacaacacatgcgcacacacacatacatactactgtgtgtgtgtgatatatatatatatatatatatatatatatatatatatatatatatatcacgtaaaataaagagattttaagaaattgtctcatctaattatggacattggcaagtccaaaagcctgcaggctggaggcaagagctgatgctgtagtttacctctgaaggtaccctgcagaattccttttcattcagggaggtcagtctttttgatctcttgaggccttccactgattggatgaggcccatcaaccttatgcagggcaatctgctttactcaaattccactgatttaaatgtttatctcatccatagacattctcacagaaatatcccaattaatgtttgaccaaatatttgagtgccatggcccagccaagttaacacatcaattaaccactacacttattttcaaattctatttgccttctttattacatcagttcaaatagctcttaaccaaatagttgttctgataccacacataaagggttatatatataatacaaatatgcgtgtgtgtatatatacatgcatatattatatagctacattatctatatctgtatatattatatatacacatatgtatattatatatgatacaaacacatatgcattttatctatatatttcctacatcacataattttaaaagtcagctacacaaagactgttttccaaatgtcagtcacatagaaggagaaccagtttgaaaagatgtacatctgaatgatagaacaattataaagaaataatttaacttttcttgttaaagaacaaggcaggtttatccttgagtatagatgggaccatggagattattttgatgtaaatcccctattgttttgggtcttagatgttgtataaactcatattttgagataacaaagaggaagaggtatatctttttataaagaccaattcacaaaatacacatgtcaaaggtcttttggtttaatggagatagcgcttgtagggtggatgtttactgcagaaagctaagctagaggaaatcttaccttcagaaattccaaaagattcaataagtagctacttgcttgatgtgacacaaagattatgtgaggtttccgatatgttctctctcaaggcagtctgactcagatctcctctaatatagtaaaaaataattctctacagcttaaatggaaatataacactaaaaatggagtagctgagaggaaatagaatttcagtcatgcagaaggaagagatggcctatctgacgtgtacaggagctacttgcattcttaacccagttagttaggaaaggaagggtggaggacacctactaattggaggatttactatgtgtcagatgttgtaccactttttagattagaaaaccaggtacaggtcggctaagaattctactcaaagatacaaaaggaataagtgaggggactagaattcaagtcttcatgacccaagctcatgctcttcccagggtctcaaggagtagcttcaaagtcactgtagagagggtgcactcccatttctcagtgaccatgtacatttcagaaatttcataatgtcctttttatttatttactattctatatggaattggcacctgggccctgttcactggtaacatagaagagccggcattcttgcctttgagatttgggatacagtcttcttcagcagattttttttttttttaaccaacaagaatgagcttgaatcaacagattttcttttactataactataaaaatacataactataaacacgctgggagctgatagaccacaacatccacaacagcggcttgactgtggtgtactctgggctgtgtactcagtccctttccatcatcatctcatttcacccttatgctgcccaggtgaggaaggcattatccatattctgcatatgaggagacagaagctcaaaggggttaaaggatttttacttaaagcaccacagttagaaattggcagtcccagaattctagcccaggcctatttgactgcacattctatagctctttaaaagagaagaagtcagaagttggtaggaagagtgctgagtgctggggaaatgaggtagttgtttttttttttttttttgagtctttgctctgtcgcccaggatggagtgcagtggcgccatctcggctcactgctgcaagctccgcctcccgggttcacgccattctcctgcttcagcctccggagtagctgggactacaggcgcccgccaccatgcctggctaactttttttttttgtattttttagtagagacggggtttcaccgtgttagccaggatggtcttgatttcctgacctcatgatccgcccgtcttggcctcccaaagtgttgggattacaggtgtgagccactgtgcccagccatgagatgaggtagtttttaaaaagcttctggggttagggatcaattcttaattaaaatatgatgtctgcatggatatgccaggttgggtttaatgtatccagacctggtctagacccagggtggcagggcagttccagtccccgcttgctgggagttgagagatgggtcatacctgcctctcctagtgttggctgagcaactgggtggctgagcccaaaatgttgggaggccactcagtgaagaagattcaacggccgtgtcatgaattaggtgacctttctttgcaaccgaagtttcctgttatatgtctctggccactctgctgaggtgtgtaataggctttctttgcaatgtaattagtgagtctgagatttaagaacaccacttagtctagttttctgcaaagtagctcaagagatcaaagggctgatttgtaaagagtgaatacaaaaagccagtgtgctgcctgctcacatgggcactctggaagcatcgacgcaagaaaaaaaaattagtaccaaaaactggagtcaaatcattggcttcagtgcagcatagcagacacacagattagcaaacttaggggcgtatggattctaaagctaaaggacttcagagatcatcaagctcttattcaataaaccaggaaactgagacacagagtggttgagtgagttgtccaggattatgcaaacaagtagcaaacccaagattagaaatcaacccactgagtgtttcttgctttatgtagcactcttccccctcctcttattctcttgcttttcctttaaattatcttatgctgagggtacctaagaatactgactcaaagttagaaatgctagagtactataataagtgtgtgtatacacaactaccatagcctatagaaaaacagaaacaattcaagttgacatctggacctgccatttacatgacatgtatctagatactgggctcttctcactgtttgtccagatgttttatgctatgtagctttcatagtattgattagaaatggaaaagattagaggctagataagagcatggtggcagagggtgtggagctttaggagtaggccttttttttttcttttgcaatgcatctttgaaagaaagcagaagggaaatatttggagctcgtaggctggggctgttaggaaaagagtggcttagatgtaggtaaataagaaaatggaaccagactggagcgatctgcttcgagttaccattggtgggattgggtaggagagttgatgtacttctgagatctcacccactactcttaaccctgcagggaaaatagtgggtttttttcccttagtaatgctaagtttacgctgatctttctcttacctatccatctgagtcagcctgtgtttcctctgtaaaaaggataggattttggcatctacactgaaaaactagatgaaatgatcacatgcactgcttattatattaaatcatattattattaaaagcattgaatctgtttttgataatattgactcttcaaataatacatgatttatttgcacactctgcagggatgctaggtagcaccattgcagtgaagcatctcttcaacttgattgatcttggtaatgacaaaagacacagagaacaggtgtgaaagatattgcttggttcactaaggcgtgggctaaatcaagagaatgctccctttcctccatccaacccaaggataccatgggctcatggctggcattaggctgaacatgttcttgccacacgtagtcattggcgctgaagcccttcacctatttcaggctgcccagcctctgaccaggaaggcacacttcagagagtggtatctggaatgagtttttccctcacaatcctggtatgtaggtttccggggggtgagtcccatgtatttctttcctactgaaccaccactgccaaccaatggttttattagtttaatattgttattttaataatttagtattataaacaaaatttaaatttgttaatttgtcttctgtgtctgcttagctgccttatgaacattaaaaatcctgacacaaaaccttcgaggtcagcatgagcttcccattttccagtaagagggtggtgccacatgctcagctcatatggccagtgggttcaagagccagactgtgaatgcaagactgtccgatttcaaagtcaatctccttatgcttcactgtgcttctcttaagtgtcaacaagcaggcctaatccgtatgaccccagttcagtgtgggtttctggtttagttctccaattcctttacctgggttaaaattcggctttaaaccttagcccactagcatgtggagagcctggagagttcttgtcaagcccctcattgttggttgtctggatcaatttttttttcttacttcttagtgagtggctggagtcttatgccaactggataaagttattggaaccaagatggtaccagctgattgattagcagtatgcccccaatggaattgcctgtgctgctgctcctttcatgagttgggggctcaccttggctatctatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttggtttccatttgttggatgaaaatggataaggttttgctttgagcatcatctgggtacctggtccaagctccaccccccattctgcctcagtaggtctgaggtgggactcaggaatctgatgtcttcctctcctgagcttcctttgatgttcatttgagctgagtctgacagttcttcagtgcagtggggaaggggtacagtaatatagagtgactttttttttatcctttctccatcctcccttcgtgccttaaggaattgctttgataattataaagatatagcactaaagctctttctaaatatatgtagtgggttatacattgattcatcttcaggccactgtttttccctaaactacgaaaattcaaggttaggctgctttaattaacatactaaaacttgccttagaaagcttatttctagtttaatgtcatttaattcaatccctgattcacagggcttcaggcaaataactcccgatctccagttattttatctccaaagaggaaaatgccttttaaggggtgcctgtggaacacagtggcacacaggacactggcagggtccatagatccttcttaacattccccgtgtggtcatcactggtcagatgtcagaatccttgatgccagtttttcaaagtagaaatagcaaatgtttgggggataattagatagtaagtctttgctcattcgtcatttcattgtatgcaagttaagtatgtaacatttatttcccatggtgtccttgcccctataggctctctctcactatgactgctgtgctctaggacacactgaagacagccacagtggtcagcagacagggtaaatcagtgagacaggccaggtgtgtgacagcagggagcggtggagatggtggcggtatggaggagcatcatctctcatctcttggatgtctttggggcagtattcaggacactgggagatggcctctggaggaggaacagagagaaatgcaggaaaaggaggggatgggatgcgagacttacttttcattttgtgctctttcatattgtttgaattttaaaaataaacagaatcatttttaaaatgaaatgaaagactctgtagacaatcacatctgatggtataacctgggatgtgtgctacaagagtcctgtccaatacagcagctatccaaaagaaacagaaggcaagctacatctgtaatttttaaattttctagtagccacattaatgaaacaaaacagtgagattaacattaggagtttatttcatgtaacccaatatatccaaaatattatttcaacatgtaatcgatataataattatgaatgaggtgttttatattcatttttcataaatcttggaaatttaatatgtattttatactcaaaacacattacaattcgaactcaccacatttcaatcgcggcatgtggctagtggctgccatactggaagtgcagcctggtcgggtcagtcttccttcccaagctgccctcccttatgcgaacacagctatattaaggagtggccggctgggcagctgctgaggataccaggctctgaggaggcttaaacactccatgaataaattaggcatctaatgccagtaacttatatttgtttcctacccccaaaacagacagatagccctctatctgttgaggtttttttctttttgagtgtgtgattcatattgcaagttttatgggccaaccaccctgggagcagccaagtgacagttgcctgggttggcagttagaatctattgatgttgaaactcagtagtgcatagcttagtgctatttactaggaatacataatgtgtcccattatctaaattataaacctcttaatatctctcctaagaatttggttgaatctgaaaatcatttaaaaaaactgaaaagataaatgacataaaagtgggaaaccttttgttcacaggtatatttgttgggagatgatggaagaattcccaggggctttcatttcactgcttcttcctcctcccaagattacctaatccttgctcccatcttgaaggtcaatcatttattctattcatcaaagctcctagttttgtcagttaatgactatgcatttggtatttcacattgctgtccagttttcaagtatttgcatttctcagtggctctgcaagtgtaatgaacatttgctgtgccgtggaagcaaggcgtagggtcctaaactgatatatagacatcatccacaaccaaaatccaaacaggtctctacccttcaggcacttattattggatttaccactgatgctatttacaactgaagcccttaacaagtgaggtgtgaccatagaaaaagacaccagtttctagaaactgcatgcatcctttctagaagcaagcaaccaaggagactgcattttctaactagagatcatatctagatatactaataataataatccatcaatatcactaccatctacagagctctatatggctgcaactatgcatgcattagcaacttgatccttgccactacctcatgaagtggatatttttattatcaccatttgatgaagaaactgaggctcagtgagggtaaataggccacagatctgtaagtgtaatagataatacatgtgaaagagcccatgcctggtgagctgctgtattggctgtaaggaggagagatgatttttgtccatgggtactggggcatttcctggaggagtaggcatttgaaatgggtgttggagcatgggttattggctctaaggaggagagatgatttgtgtccaggggtacaacaggcatttcccagaggagtgggcatttgaaatgtgtctttgagcacgggtaggatgtaggcatctggagatgcctagaatagggaataaaatcagtgaagacttgggaatgggcaaatataaggcacacaaagggagtggcaattgtcatgagtccagtgttcccagagtgattggaacaggagcagctgcggggaggggtttgcacagaagatcggtgacagtaggtgccaaacacccactgtgtgacagattctttgctagggcttcacatagttctattatttactttccaccaaaatctgtatggtaggaagtattactatctctgagtcacaaataaggaacaccagactctgaggggttaaataacttgctcaggtcatacactagcaagaaaaggagggagaatttgaatgcacatctgtccaaccctttccactgcaaaatgaaacaaatcatgttttaaaaagacacttttccgaggaaataatgtcctgcttttatgctctgccctgtgacaccaattctccagagttgctacatttctatatcgaggcaagcccccactcttggtgcctcctctgtgatgtgcatccccacctccactcccaccgcacctctttcaatggtcttctccctcttgcctggtctttgcctaataggaataaaacataaaaatcaaaacccaagaaaagcccaatgtcatgattatcaagtagctcacagcaccagctaggattttaccttaggggtgagaagatttatattgcaataatcaatatctcagaaatatgtggctcactttctgcaactgacattccatttcatggcttcaaagcaatggttacatcagccagtttgcgtctttaatatagtgaaatgcctactgagggaagtcggtggagcatgtgctgtgggggtggggagtctttattgccatctaatgaccctaaaatcagctctctggttatccagcacgggaaagcaaatggaaccttccatctcatccatgacaaaagtattgagtggttctgaagttatttgtacaattgatccagctaatatcaggaaagcatgttcaccagatgaattagagacaattaaatgcaattctgtgctcctgttttctatacacagaagacaatcataaacccagagggtccaaatgaaatcatctgacccattttaacaccctttccgtcccacattcaccattctagtccactgaaaagcctctcagatttccactcgatgaggtgatttcatggtgcatttctgctatgcaatccccctacctcttttactgtcaatgaacttaaatgctcacagcaaaacttattttcatgagttcctttcagttgcttatatacacacacacacttagcagagtaacctttccttcttctccttcttcacctctgacatacactcattcaacaatttaaagaaattccacctcctaaaaaccctctgtaatctgcccattctctctgtctctgctaatgtatcttattctatccctcatcttattctgacccctcctctctgtcccccagacatggcccaacttaagcccttattttaccatatttcctgaaatatgccataggttgtgaaatatatcctgattttatgaaccaccatgaaagtaaaaaaaaaaaaactctacaaataaaataaaataaaataaaatatgccattgtttgtaggaggcctcctaaagagatgttgaaacatgaaaaaaatgtgcatcttaaatggatgatacacagtatctctatgaaactcttatcattgtctcctgactgctcatgccaacaatcttgtagtggcacaacaggcccttcacaatcaggctctgagctgcatctccttttcctaggcttgcaaagccccttctcatttgtcaagaccacctcctcaaagtcctttgaaaccccacaggcttggtgatgatgcttccctgagttcctatgacttccttaacttaagcgtaataacacataaacatagctttgtaattatctgcccccatgtcccactatgagaaatccttggagaaaaggctatgtgtctccttcacctccatatccccagtccctgacacaggacagggcaggtcctccttgaattgctgaatgcaatggactgtgtgatacatgtagcttctgaacctagtcactagagggcagtgtggaaccatcccattgcccacaactgcggttccccaagaatctaggttgcagaggttgtaggaagctggcctatggctgagagcctaggaggctacatgactccaagggcccagtaccattctgcagaatcgaccctgaggatgctcctagcatctccgtatttcttgccagcctgcccactaggtgctttcaagtggctgcctcagcacatttcttgattaagaaccaaatgctcttcctagctctccacctatagggatgggggcagaggccacagagagggaaataaacgtctccttaacatccccattctcatttctaataaaggcaggcttactgtgaagggcctgcaatataactgctccactttgaagaacaacaggtagcagcatcaatatttgatttttaaaaggttgtgtgaacagttttaaatattaaagataaaggcaaagacttagatcatctttttatctcagcagttgaagattttaaatgaaaaatggtgctaatgagcagaataagactgttcacccatcaaatggtatctggttgcaataaagcaaaatcattttggggttggggggagaaggggtgggaagcaatatctgtaccagagaagttttctgttcattatctctgtaatgagagaaaaataaagccactctgctggagtaactttcttctatctcatcgtgggctgtttagctccctcaatgagtggtctgggacaggctccgagaaacctcataaattaactatccaacttcctggctaatgagcccaatatgtcaatttctagtgatcaaaatgatgcaattcaatacagcacagttcattttgtaaggaaatatactcttaatagagagaactgcagggtcaccgtcttcccaagataattatgggccagagaattagaggcgtggagctgtacttactgtctggagatatcccatggggtttgtgtggcagatattgtctttcagggacaataaattccttcattatatttccattactgcattaatgcagcgatctccattttagttgtaaccaagaaggctggttattcctgaaacttggcatttaatgctaatgagagcttgcaaggcaggcagctccctgtgtgtgtgtgtgtgtgtgtgtgtgtgtgtgtatgtgtgtgtgcatgcatgtgtttagggggggttgggtatagacaatccagcagaaatgtcaagaactagaaggtaccagggagagtctggagggctgagatggctctgaccagacagacagatggatatctggaagagtcaggggtaagtagtctgagagccaagagtaaattacagctgaagagagaagctgagatcactacgaggtaagcagtgccaagtgtgaaatccagcctgagaaagcaggtggtcctgaaggtgaaacaaacagatgcaattcaaaaacaggaatgccgggcagcaaaagggttcaggaatgctcggaagtaagcaatggtgctgtaaactcatcctaattcagggttgcctacgaggtatgagaaaaaaccaggcacttggtggtggagccaaaggcagccctagccaatgatatctctttaaaaggctccagctcaaggtagaccctctaagagcaaggactccatgttcaggcttgctggaattgcttgattctataatctgcaccccaaaataaggtacttatttggttttaaagttagaagtggatgaaaatgaattccacaagtctccatgtgagagctgatgaagctccagcatgctatctaaccatgctggaaggctctgatctggcagggagaaccaggtgggaaatactggtttcactagcatttttcaacttgattccagtggagtggacaggcaacatagtaggagaaaggacagctcctggggtcaggttcaagttctggctcctttgctcttagcttcatggtgttgggcaggttgcttaacttctctgagctgtggtttccttagctgacatttaatttgctgggcaatctatctatttgcagggaagtggggagataaatgaatatgtcagtttgcttatttttgcttatttttatttctccaacaccaaagataagaaaaaataagttataaacagaatcaggattctttcccttgaagcaattcttatctaaaatggactttagtcaggaaagtaaggttgctgttaactcaagtaacttgggaaaataattgtgaaaagaaaaattttccatgaatcagagagctcaaaattataatatgttaattaggaagtgtttacttaaggtgagaagtggattgtgctaagttcaacatcctgccagaggtcctcgataggcaatgactggcaatgcccgttagcttgctccatccttgcaataaaactcattgtccagaagtcttgggaggtgccttggtagagatcagttgctatttaaaaaatctctaactgttgacttttaccttgtcttggccattgactaaatccaactattgtgcactgagtgtttactaactgcaagttcattttaaatgttctctcatttgatctttataataattgcatgaggaggatttaattatgcctgtatttagagatgagaaaactgaggctcagggagtttagcttaatcacatggttagctactaatagaagaagaggggagtttcacactcatacttcattcatcattaggtggatttcatatctcacattatttttagtactcatcctcagtgactctggctttgagcctcttaaatttgtaaaacaaacttgatattttggaataatttcagtaggtctgcagaaaagttgcaaagatagtacacagatttccatatatccctcacccagcttcccctaatgttgacatcttatgtaatcattgtacatttgttacaactaataaggtaatattgtttcaccactatcaactaaaccagtgatcccccacctttttggcatcagggactggttttgtggaagactatttttctagggatctaggggtggggggacagctttgggatgatcgaagcacattacatttattgtgcactttatttctattattattacattgtaacatataatgaaacaattacacaactcatcataatgtaaaagcagtgggagccccgagctttttttttttgcaactagatggtcccatctgggggtgatgggagacagtgacagatcatcagtcattagattctcataaggtggacacaactcaaatctctcacatgcttagttaataatagggttcatgctcttaagagaatctaatgctgccactgatctgacaggaggtagagctcaggcagtaatgtgagcattggggagtggtccatggcctgggggttggggagcgctgaactaaactacagactttatttggatcttaccagttttttcacttatgtctggtttctattccagaatccaagccgggatactacattgcatttagtgactctcagttttaacctgattatttgccacaatttccttcgggaaaagttcggggtagggataaaggctaacattttttgtagcctggatccacataaagatgtgctttttttttttttttcttgtttatcttttattttgcttctggtagcagcagttcttaaaactcatggcacacgacactttcattttggcctgggatcttggcctgcttgtacaatagctgcaaaggtttgggattgagattcagctttcaaaagcgactctccatcactgtcttctttcaaggacaggaaatttcaaatcaactttgggctttaccattcagtgtgccaaacattcctgaagtttctacgattgccaataaataagacattccatcatctttaagacatcaaatcttctgataaattgaatttcataaaatattgctctattgatcttagtgctcaactttcaataaggcaagccagcaagagttgctggctggtactttttctgcaatgaggatgtcatctgcttacatggggagagacatttatgaggccagggttcctgactttaaatttcagttcctggcactatatcaagtccacagtgatgacagttaccttctctccattgctgctgctttaactttatagaaaactttgcttatgcttattaaacaatgtggcacaaaccctgtgaggctacactgcaagtcatgtaagctagtacttggcacatagtgggtatgtgatctctgttaaagctctctttccagctaggacaaaggaaaatcaaacttgtctcaaaactcaattttgagagttcatctcgttttcagaaaggaaagggccaatgatgaaaactgatgacatggcaagactgagaagaaaaaaacacagtatttcttctccacacggtttttccagggctgctcttgaaattgtctgcaatgatgtgcatgtattttttttaattttaaaaacaaataacatttttatacttttataatgacaacatgtcttgaatgccatctgttcttgccatttgttaaggcaactcaatgagaaaacagcattcggatgactaatatttagcctgctcatagtttttaaaatggatggacagattcccttgagattacaccccaggatccatggcaagctggtggggtgggagagctgaaggtggagtttttgccactactgggcacactgggtcactcacccagcatttcttaagcaatcacaaggtgccaggcagtgtgctagaactagaaatataatacaaagataaaagagagactcatctctcttgtggggactgaggagtaaatacacaattctgtacaaaatggtaagtgctaagacagaggtttgcaaagggacgtagtgaaatatgtagaggaagttaatgactcacaccgtgtgtgtgtatttgggggtgatggggagtgggttaaagggtactcagaaacatttctgggaaggaaataaaaccctgacatcagtctagcagaattggtagacatcagctatatgtaaaagggggtggattcaggctcacataaatcctatgagaccagcacagtgcatcaaagatatatttccagtcatccttctgtttgaactagaccagagaaaaagtgtattcaatatagctagtgagttaaacactacttcctgggcactcaccagtgcatcctaaaacggttgatcaacatgaattgattgttcagccccagaccaggtaaagaggggatataagagaagccaacgtggttgatgatgggagggcagccgcaattcagccacaggcaatgatcaaatagcaatgtggggcagtgtgtaaatatgggggtccatttatgctcaagaaatgggtgcatcctctgttactctgaggccataaagttgctactctgagtcttttttaggccagttgctggaggatctggtgtagaaaggctagacaggaaggagatctaggaggcttcctcccaaatctaagattctatatctctgttgctcttttataggactgaggttaaaccttttaaaaatagcctctgtagttttttttttttccctagagctatttgggtgtgcctgtctgtttttaattcataagaatgcacagtagctgcacattgtaaaatgcattcctgacaccctccccgccccgcccagaaataaaaagctttccaggcatgacttctacgttattctctaaatcatagttatctgtggtgaccagcaagttaccaaatatggctataatatcctatgttttctccatatgctatggagaaacaaagaacccctaaacaatgaaaactaaggagacacaaaccctcccccgagaccctaggcttggaggggcacgaaataataccaccattaatactaatatttgctaaactgtattgtgcaaatttgctcaactgtttcctctgtttcctatgtgcaagaccctgtgctgagcacagtatctcactgagtcatcacagtaatcctgtgagctggtactgattgtattaggctgttcttgcattgctatacacaaatacctgaggctgggtaatttataaagaaaagaggtttagttggctcatggttctgcagcttgcagaggaagtgtagcactgtcatcagcttggattctggggaggcctcagggggcctttattcatggtggagggcaaagagggagcaggcatctcacatggccaagtgggagcaagagagagatagtggtgggggaggtgccacacacttttacaaagaccagatctcagccgggcgcagtggctcacgcctgtattcacagcactttgggaggctgaggcaggcagatcacgaggtcaagagatcgagaccatcctggccaacatggtgaaaccccatctctactaaaaatacaaaaattagcctggcgtggtggtgcatgtctgtagtcccagctactcaggaggctgaggcaggagaatcgcttgaacccaggaagcggaggttgcagtgagctgagatcgtaccactgctctccagtctggcgacagagtaagactccgtctcaaaaaaaaaaaaaaaaaaaaaaaaaagaccagatctcctgtgaacccagagtgagagctcactcttcaccaagccattcatgagggatccacccctatgatccaaacacctcccactaggctccatctccaatactggagattatatttcaacgtgagatttggactgggacaaatatccaaactatatcactaatgttacacttgttttatagatgtgaaaaggtgctccttataatggaggatgattgacctgtccaaaatcacagagcaagatggtgataaaatcaggtcaccaagccaggcttgcccagtgctaagacttctccctattatatcacctcccagaattaagacaatggagttttcccatgccacacccagcattgcctactctctgtaatggctatgttgggtctggagactccgattttccatgaaactcagtagtcatacacttggaaatctcaagttctgcctttcccccttttggcatgggtggctgtcccactatgtctcagccttgccacttcttcctaaatctgagaaagtgaatgttagccagccctgactctttcctgttgacttagcaagcactgattgaacttgtacttggaacaatggtttcctaggttctgagtggcagaatggggcaggaggggaggagaccagtgaggcgaggcttgaccaataccaagctggctaacatcaatatggctctttaccattttacagagagtgttcacacactcattctcctatggttcccacacaggaatctctgaagtaggagcaggcatcccatctcacaggtgaggacaaagcctctcacagagtgtatgtgcctcatctgtggccacgtgctctgcagaatcagggttcaattaccatccctgtgatgcctcgtggagtgctctgcattgctgctggaatcctatgtctcctcctacttactttcctctatttcattctcatacatagctgaacctctctgtgcctcactttcctcatctgtatatggggagaacaatagtggctactgttttgttgtgaagattaaataaggtaatacatgtaaagatagttgaaagagtacataacacataataattacttaacaaacattaggtactcatagttactattaacaattactagtattaccattactgctgatactatgatgcacacacaagtaacaattataaagatatatgcaaataaatgcaaatgagtatatgcacttgcttattattttacaatgaaagtgctgaatgatacgaagcaaaaaaaagtgatataaaataagatttcctaaacttggctgtttttgatatatatatatccctaacatttcatgtttcagtaattaaggccatgaagagaactaaaatattgactaaatcctggaggaatttccaaatgggaatgatggaaagacagacacagagacaggccagccaccacagccaccaggttaaaatgagggaaggcctacaattgccatgggaacagagaagacaaggagagggaaaagagagaagcatttttttttttttgaactaggccagctaacacagttatgtaacttaattgtcataactgtcatgtgagatacatggtattagcctcattttacaaatgtggaaattgagactcaagttcaagtaccttgttgaagtcacaaaatgaaatggaattttaacagacttttactctaaaacccatgctttctctacctctctaccaccaacagaagcttctggggagcacctcgggagacagccttttgatgtctcccttctctgggctcttagagcacttagcatctctgtaattcatgcacacaacactcacacacagcatgcattgctttatgtgcacaccagcaagtgatccctaccaccaggccataagctccttcaagacagagtcagcatcttagttgcttttctatttcctacctgactaacatattgacttgtacatggtaagtatctgttgagtaacctagtagagaagagagattctatgatataaaagactgaggagaatgcaaaagctttcataatcaaaggttgctcagtgtgtagaacattctggaagccaggttggagtgatacattcccaaccctggttatagaggactgactcaagtatggatcctttactgcagctgagctgctcagataattgtctttcttatttgggactaggactagggagattacatctggggtagtctcttagagacaggggatgtaaactgaggctttgtgggctagtcatctcctgtctgagaagcagagagaaggatgaagtagacattcagtaggaagacaccctcagagcctggtggagaagttgctagatttctgcaggattatcatcatggaaaggatctcactgggcctttgaagccagattgctcaggtctaaatcttggttctgctccttataatcagtgtgaccacgggaaaactgtttaaccagcccatgcctcagtttacccctctgtgaaataaagatgagaataccttcctcagggtgccatgtcatgtgcttcagcacagtgctggatgcataatacaacttcgatgaactgtagctatcattttaatgttgggcctccatttgattcttttgtgctttccatctgaatgtttcaggcatcttgtatactttttccttcctgctttcagaactctcagaagtccaattgctacttgcaacacaaagcaaatcaagttggctcggttgctggtagacagacctgtctcttcggtggtttctgcctgagcatatttatcagctactagccagaaacacacacctgtattattataagtggcaccccaggtcccagcacatttcaaagcacagactcttctctccttctaaggagaagggcctctgcttctttgttctctttgattctcagggcttcttattaatttggtatagggctggggatattaatgtcctcttgttgtcaagaacattctccaaagtcatgaataatcacgttgtcatgcctgtgtgacttaaaatacaaaaggtgcaatttatgcaagttttaaagttactttttcaaaagagttcaacccatgaagctgtcaggctgtcagaatgtaagcaccaaactagaaccttagcacttacttatgaattttcaaaggactttagcacatttttaattagcttctccccctgcccgcaagcctgcaaaacaatctgtttggctattatattctgtgagtggggtagcaatataatgctagattggtgggaggggtgagtggaaaccttgcttcatttaaggtcttttttttttttgaggtggagtctcgctctgttgcccaaggtggagtgcagcggtgcgatctcagctcactgcaacctccacttcccaggttcaagcaattctcctgcctcagcctccctagtagctgggactacaggcgcacaccaccacatccggctaatttttttttgtatttttagtagagacggggtttcaccgtgttgcctaggctggtctcgaactcctgagatcagggaatccacctgccttggcctcctgaagtactgggattacaggcgtgagctactgtgcccagcccactcaaggtcatcttctaggcttcaaggccatgggccagaaaccagttttttcaagtaatttttatttttattaaaagatagttgaggaaagaaagcaggatgccagccagccagccaagatacatgcagaggtttttaatacatacatcctatagttacgcaccatttctccaagcacttataagtaccccaattcacctgaccctcccaacagtgccatttattcccctcctcttacagatgggtaagcaggttcccaggccttgggagaccattgttccccatacctcctgactcatgacaagggactgttcccagagaaacacttctggactctctgccccattctcactcctctaaagggggaggggcatacttctgagactggtgacttgagtgaaaggactgggcctgtgaagctcagtgccatgctatctgctctgaaaggcctgctcacagagagggcacagtctggtttactctcttggctgtgctgggacttcagtggtaaagacctgtcctcactgaggtcagcctgatggtttagggtaagtttaatttggggtgatggtgtggacaatgctctcaaattcactttgcagcatatgttagctggatcccctacacagttttcatcatccataaagctaacgttttggctttcacctgactcctgggtctttctcttaatttaagccatgcagggtacaaggggggtgggtagggaatgttatttactatagccatctccaacacaagtaagaatctattgtaaatagcaaagctgttcttttatttattccacacatatttattgtgtatctactatgtgtcagggcccaggttttaaataagagtcctcatcaagtatgtattttagtggtggagaaaggcatttaacaatgaaatgcacaattacatggcaataaggacaaagcaaagaagcgtgggatgctgggagaatgtctaacagggagcacgacatagtcttgtctggaagttgaaggttgttttctctgagcaagtaatatttaaacaggactcagggattagcaggaagaggccaagcagagtatgtatgtggggaagaatgagggatgatctcttcacgtggtacttgggaacctgaagggaggcaggtgtggctgaaacagagaaacagaaggggaatgggacatatggcaagatgcagctggtaaggtaggccaattgtgcaggatcttgtgggtcagattgagaataccctaggtgttttctaaggtctagagaagatcttagaaatgagaagccattgaaagccttaaagcaagagtgagatacactgagatttggctttcacaaaggtcaccctagctgttgtgtaaagaatggattagagctgaggcaggcagatcacctgaggtcaggagtttgataccagcctgaccaacgtggcaaaagcctgtctctactaaaaatacaaaaatttagctgggcatagtggtgcatgagcctgacctggtgtgagtagccccagctactcgggaggctgaggcaggagaatcgcttgaacctgggagatggagattgtagtgggttgagaatgcgccactgcaccccagcctcagcaacgaggtgagactctaagaaaagataaataaatataaaaaataaaattttatagtagccacattaacaaaagaataaaacaggtaaaatcagttttaagaatatagaccatttagctcaatctatcccaaagatgatcatttcaacaggtagtcaaaataaaaattattaatattttacatgcatttttaatacaaagtctccaaaatccagcacatctcaacttgagtaccagattttcttattagtacttgatctgtgtttaaatttcataaaacttgtagttgaaaaaaatattcatacacttaggtcatactaacaaatttgaaagctttccagtaactgaactgagtatctgtttttcaatttaaattagtccacattaagtaaagttaaaatgtcagttgtttgcactagccccatttcaagacctcagtagtcacatgtagctagtacctacacgtattggacaattcagtcctggagaatctcatctgtgtagcggggcgtgggagtcaggtttttcagacaccaagggccaagaaccgttcctggcactccaggcctgcctgcgattgggcagagcagactctcacagccagaggaagccagaggcagttggtagttaggtagccatagaaccctgatgaaaataaaacccaaagggaatagggaagggatgaatccactgcaagagaattcatgttggaaacagtttatagactgaacaaaatgagaggaaaaaagagagagaaatcaaatatgatttgtaggtttctggcttacaattgtgtgaatagtagtagcatttactgcgataggaaggatgggaggaggccttggtttggaaataaggccattggtttgattctggacatttgagtttagagttcctgtgaaagatccaagtggtgatattgagttggctttgagatgggccagctgagagatcaagaaatatttcaggacagtttagagcttgactaataaaaacaacgtatttcacttgtacacagattttctttaaccaaatgcagatcaaaaatacagtatttgagggatataaaacccacatatatggagggccgatttttttgtacaagagttctgctgagcccactacaggacttgagtatgagcagatttggatagacttagaagtcctggaaccaatcccctgtgtatactgagggacaactataaagggaatgatcagatatgtgtatagtcatcttaaatattatagcatagctcccaggctgggcacaagatgaaacaatggccaaattgcagatattaatatttataggccaggcgcaggggttcacgcctgtaatcccagcacttcgggtggactgcttgagcctaagagctcaagaccagcttgggcaacatggcaagatcttgtctttacaaaaagcaaaaatatttagccaggcgtggtggtatgtacctgtggtccctgctactctggaggctgaggtggaaggattgcttgagcctgggaggttgaggctgtagtgagccataattgtgccactgcactctagcctgggcaacagagcaagaccctgtctctcactgtccataaatattatatatagatacaaataatgtggttattgatggagcctcatctgttgtgaggcaggattggctcacagcactcccctcagtttagatagaaaagatccttcaggaatgtatgttcccctttgctctccgagtccaagtaccttttgttgacaaatgatagtaaagagagctgtcttgggtaaaggacatagtcttcagaaagtgcactctcattctaaataatagcagccttcagatttatgctgtcttcttctgggtgtttgtttaccttgggttagtctttttgggacccatcaactctgaaggtcctgtttcatgggacaaagccgctattgggcacatgaaaagctctccccagactcaactgatggactggagaagcaccagaggcacagctcacagcccttcagacccagcatgctgtggaagtcaagcttggtcagctggccttgcctgtaagcttgctcaggggcatagatcgctatatgagtactcttcagatagctttctaaggataaggccaccgaataggtgatccagatgatgaggtcttacaggatttaacactttgctagtaggttttgttccattaacttagatgggattgcagaaaacacaccttgaccacatggtaatagtcctgatggctgtaaaatcacatctaacacctttacgcagaggaaataattcagtgtcaatcatttgttcaactcaaactggtaaagtgcctacattttcccaggccttgtgcgaggcatgggactcagagatgagcagggcactttctgtttccgaaacaatcagaggagagtatgctagaaggtacaacaaatgcaggggatcccagaaatggggcctctagctcaggctgctcagggaggagaggggtgtttcctggagaaataaactgcttagcggaaactgctgaggaaatagaaacactggagcctcgtgttcttgggtcagagttggacccaggaactcaggcttctacctcctggaaggtgctgacctccatcagccagctgaattagcaccattttatctacagcaagatcaagagagagtctgtggcaggaagtacagagcctggggactgcgaagaaacagaaaactataataatactgaagccctcagaaccagagaaggggacttccagggtgcaacagaacaggtgtttgggagttggcaggttataggcactgttttccctttccaaaaatgggagaaaggtaagtgcctcgagagccctgtggaggggcctggtgtctcggggctccctgtttgttacccctgctctgccctacatcttcccagatggaattctggccacaagttatcaggttgcagatgaatagtgaatactttttttgaatttcatcattcttccccctagaatgactcattacaaattctgcgtccatgtgatgcattaatattgattaagaaacaggtgctctcagattcaattagcaaaactgcaatgattcacacagggttacgctggaaaattgggggaaaatatgcaggtgtgcaaatgagcctaatctgaaggtgctgcagcaggtcttgaaaaatgcatcccctccagcaaatgctttcctggaattaccctttgtttgggtgacaaatggacttgccatttcaaccaaacagtgaccccaaacctctgtggcttaggatccagtggaacttcacatttggagtcagacttctatgtcgggattcccaagctttcctgttgaaccactgcagctgtttgtgaaacacacagcttccttggccccaatctaggtgattcaaattcatggatttaggtgaggaacctgaaaatctgtaccttggaaagtaattcatgtgcctcttgtcatagacaagttagggaatgtgcctcaggagaaggctggaaacttggggctgggaagtgctgcctgcggttggatgatggtgggcacctcagcgacatcagccacccctttctggcttggctttgccatatgtagtatccagaggctatatctctccctgtggatgctgagtgagtagtgttctgatctaacacacataaaacaggaaggaacatcacgatttggcaattaatactttttaacagaaaaaaaactttaaatagattctagagtgtaatcatagacattcaacctggacttctagaacattcttgggcttctttctagcaaaacctcctttgacaacaaaagagagtttgtgacttagatgtcttcctgactgtattttagagtgctaaacttcagtcatagacatcagagtctcatagaatttttagggcagggagggacatttgagataatctagttcaatcctttcatggtgcagaggaaggcatgcaggctcatcaaggtggagagacttgctcagtgctacttgggaggtaagatgagagaactaaagatgagacagcacattttccgagtcttggcttccagctcccagtgcctctttctggccaccacactgtttctgagatcccctcattatttgaccacagtatgctaagaagcagggaaatcagcaaggacttcattttctttccatacatattaagtgagagcccaatatattcaaggaattgagtggcatgatgaggggtaaggatgcaaggtcacatggacacctaaatgaacaactgcaataaaatatgacaaatgcaagagtagaagtacacacggagcagtggcaactcaagagagaaagtgactaactcctcgaaaaattagggacgtcttctcagagggtattgagtcaaaagtcaaatcttattatgtcctggtgaaagaaatggcacacctggcagaaagaacagtgtgagcaagagcctggaggtttcgaattctaaagcaagtgtcagcaaacattttccgtgaagagcaaggaagcaaagatcttaggatttgtggtcatatggcttcaactctgttgtggtagcatgacaacatgtaagtaaatgggcatggcagtgggctaataaaactatttacaaaaggaggcagagagccatatttggccagtgggctgcagtttgttgacactctcttctaaatatgtgtctatcataagtagttcaggatggttggagcatagagcttggggaggaagaactgggagggaaggcgtgacaagatgaatctgatcagcttagtaaggacgagatcaagaagggactccaatggtaaagacatgcttggacaagtcatttatcatctctgagccttacctttctcatctgtaaaatgggaataaaaataattcctgagaaggactgttgtggatattattataatatctgagataaatccagcacagttcttgacatttactgagtgttgtaaaatgttggctgctattcatggcactttctccataattgggatgcatttgaagatggagatgtgggattgtcatgagttcggaaataggctctagaagcaaggtgttttgttttttccagcaggttaaataaggaaaagagatgctatttggccatgagtccagaggggaagtcttcaatggaggctctagatcaaatggcctcttattatctgaactcacttgcattaataatgatgaaaatctacttgttcatttcctccactggactttgagttccttgaaagtggaccaattcatttgtcatctacagaaccagaaacacaataggactcaatgaatggctaataaagatgtctttgtatctgtttctctgtctgcatgtgacacctcccttttcttttcccctttaagtcccacctttatccctatgccatatagactttgctgttagaacaatcatgacatgtaacagtttttgaattcttactatgtgctaggcataatccttaacaatatatgtataccattttatgtcttatataatgaggtaggtattagataacattgagataggtattgttattattcctattttgtagatgaggaaacagggctcagaagatttgctccaaatcttaacagccagtaagtggcaggactgggatttgacttatctgactctcaagcctgagtttgtgcactgtcttccgatgttctaattcattccatgtacattagtctctttccccaatcagactgtttgctgaatattttatttctttcagtacccaacctaatgtggaaaagcagacatttattaaatactcagagacttaatttgaaaagacttttgccccgtggtcatctgaatactccaaagaatgtactactaacttgttctcacctttgggaatcaccaatcttttgtcatatgggaaaaatgaaaatatttttatctgtttatatgctaagcagcattataacagctgcctgaaaatctaggcttcccatccatcacacaagcacctggatgctgtaatcacagatgacaaaccagctcatcagtgaggtctctttgcagaacaggtttgatactagggatcttcatggagaaaacattttctccatcaaaatgaaatgaaggcccactggactagaatcttccttttaacaatggcagatggtatccagcattggttcatttctttctgataagaaaaggccaagcttgcttctttcatctcttcattctccatggagccaggaaaacagaaagaaaagtatgatagatgtgtgtccattttctgattgtccagcgtccaacccccttgaccaagagggatgctgtctctcctccagtgtgtatgatcttggcaggaaagcaattctcaatgcctgtcctccactctggaaacttggagcttagatccttccaatattcctggttcagcagggaggcaggatgttgcatcctgagtatgtgatagcaaatggtggcttggcagacatcagcttgacccagcagtggtagagcagtgatggtagcagtgacgtatcagtgtcactgacagcctcctgaccagcatgtggttgtctctgatgcttgacttcccttgctccaagtctgctcttctaatttcccaccaatctccttccagaaaaatctccattttgcataagacagccagagttgatttctgttgcttgcaaccatgaatgctgagtgacataatatgggaagtagactttttatctacaatcacccagctgactgttgtctaaatagtcatctcttttccctggagttgttttactggctgaagagaaatgatttttttttctttccttcccatatttcagggacaatgataagcagggtaatgcccccaaagcaggaactacattgaaaatgaatacttattgaatggcccattagagaagtatgaaagctcatgttgcttttactcattgctctattctcaaaatgtagaacagtgtttcacacaccctgggtactctgattaatgaattaattacatggtacttattaatggctaaataaaaactcagattttcacatttagtcttcacaacaaatatacaaactagcaaccactgtctacattatacacataaagaaaccaaaccccagcaaggtcaagtcgctttcccattattgctgattaatgttggagttggaattctcagtaaggaccacctaactccaatccaggctttttctattccctatactgaggcaggcaaggagaataagaaagaagaaggaaaaaaagaactgaaaagaaagaaatagagaaaagaaaaggagacaagaaaagaaaaggcagtgaggtgaggtgaaggtctggttggtttaaaggggggtccttttccttggataaatgagaatttccagagtcagttctttctcagatacaaatggcagaagagggtgggctctgttaggtgctgaggttctgcagtgggaccaggaggctgaggttctgaggttcatcctggcccagagagagcaggtgtgagggggccgctgagcagacagcacagcagttcccatacacagctgtgtaggagcaaggctggagagctggcctgctctccatctttagaatctgcctactgggctccttgaaagaggaggggcctgccagggaagtggagtgcagcggggatggtacagggagggaactgcttcacctagcaggcagcactgtgtatatggtacctgaccccccttctctacctctccttgtctaggggttaaatattattattcccattcttcaggcagggaagcaaaccagacagcttcagttacccaaggccaagtgcccattgtgaactctgggagttctcagaggagctggctggaccccatggagctggcaaacccatgtatgtggaggtgacatttatcttctcagccaggaaggagcacgccatccagctgctgcccagagcccaggagaaccctgcagcactgtgattctcattagcctctgaaaggtgtgagggaaacatggaaggcagttatgcctggttttggaaattagggaggtttaatttaaaatatgtcagtttaaaacagctctcatcaaaacctactatggaacactaggacttattctgtctgaatggattttttatccactaaccgacctctgtttatctctgtcttccgccccttcccagcctctggtaattaccattagacactcaacctccatgagaacaactttttctagctcccacacattagtgagaacatgccatatttgtcttttaatataattttttatttttaggttttgtgggtacacagtaggtgtatgtatttatgcagtacaagagatgttttgttacaggcatgcaatgcataacaatcacatcatggagaacggagtatccatcccctcaagcacttatcttttgtgttacaaatgatccaattatactctttatttaaaaatgtatacttcaattattattgactatggtcaccctgttgtgctatcaaatactaggtcttattctttcattctagtttttttgtatcccttaaccatctggaccaccccgaagtcccccactatgcttcccagctttggaaaatgatccttctattctctatctccatgaattcaattgttttgatttttagatcccacaaataagtgagaacatgcaatgtttgtctttccatgcctggcttatttcacttaacataatgatctccagttccacctgtgttgttgccagtgacatgatctcattctttttttatggctgaatagcactccattgtgtatatgtaccacattttttatccattcatctgctgatggacacttaggttgcttccaaatcttggctattgtgaacagagctgttacaaacatgagagtgtagatgtctcttcgatatactgatttcgtggttattaatcccttgtcagaatatataaagagttcaaataactctataggaaaaaatgtaatccaacttaaaaatgagcaaaatatttgaatagacatttctcaaaagaagacatacaaatagtaaatagaaatataaagagttgctcaacatcactgatcatcagagaaatgcaaatcaaaactacagtgagatatcatctcaccccagttaaaaattgcttatatccaaaatacaggcaataacaaacgccagtgaagatgtagagaaaagggaaccctggtacactgttgggaatgtaaattagtacaactactatggagaacagtttggaggttcctcaataaaaaccaaaaatagagtaccctttgttctgttcaactggcctatgtgtctgtttttatgccagtaccatgctgttttggttactagagctcagtagtataatttgatgttaggtattgtgattcctccagttttcttctttttgctcaggagagatttggctattttgggtcttttatggttccatataaatttaaggattattttttctatttctgtaaagaatgccattggtattttaatagggatcacattgaatctgtagattgccttgggcagtatggacattgtaacaatatggagtcttccaatccatgaacatggaatatctttccactttccatttttttggtgtcctcttcagtttctttcatcagtgttttattgttttcgttatagagatctttcacttatttggtatttaaattcctaggtatttaattttatttgtggctattgtaaataagattacttttttgatttctttttcagattgttcattgttggcatatagaaatgctactgatttttgtatgttgattttgtatccttctactttactgattttttaatgcgttctaacatctttgtgtgtctgtgtgtgtgtgtgtgtgtgtgtgtggtctttaggcttttccaaatataaggtcagggaggacgcattggctcgtggctgtaatcccagcactttgggaggctgaggcaggcagatcacttgagcttaggagttcaaggccagcctaggcaacacagtgaaacactgtctctatgaaaaatacaaaaattagacaggcatggtgatgtttgactttaatcccagctatttgggaggctgaagtacaagaatcacttgagtccgggaggcagaggttttagtgagctgagattgtgccactgcactgcagcctgcgtgacagagtgagactctgtctcaaaacaaccaacaaaccaaagatcatatcatctgcaaacaaggataatttgacttcttcctttccaatttggatgccctttatatctttctcttgcctgattgctcttgctaggaattccagtaatatgttgagtaaaaacattgagtactaacatattactcaacatattactgaaaagtgggcattcttgttatgttccagttcttggaggaagggctttcagattttccccattcagtatgatactagatgtgggtctgtcatatatagcttttattatggtgaggtacgttctttctatacctagttttttgaggatttttatcatgaaggaatgttgaattttataaaatgttttttcagcatttttggaaataatcatattgtttttgtccttcattctgttgacatgatgtattatactgattgatttggtaggttgaaccatctttgcatcccagggataatctcacttggccatgatgtatgatctttctaatatactgttgaatttggtttgctaatattttgttgaggatttttgcatcaatattcattagggatatcggcctgcagttgtctttctttgatgtgtctttgtctggttttggtatcagggtaatactggcctcatagaatgaacttggaagtattcccttctccattttttggaattatttgagtaggattcagcagtgaagccaatcaggttccaggcttttactgggagactttcaactatggcttttatcttattacttgttatttgtcttttcagcctttgaatttcttcatgattcaatgttggtaggttgtatgtgtttagggatttttccatttctcctagattatccaacttattagcatatagttgctcatagtagctagtaataatcctttgaatttcactgatatcatggttttttctatttttcttttttttcctttttttttttgagacaccctcctctctgtcacccaggcttgagtgcagtggtacaatctcagctcactgcaacctccacttcccaggctcaagtgattctcctgcctcagcctcccgagtagattggactacaggtgcacaccaccatgcctggctatatttgtgtgtgtgtatttttagtagagatggggtttcaccatgttggtcaggctggtctcgaactcctgacctcaagtgatccacctctgccttccaaagtgctaggattacaggcgtaagccactccccctggcctcagtggtatcagttttaacgtctcctttttcatttctgattttattcggattttctttttttcttagtctgcctagaagtttgtctattttgtttaacttttcaaaaatccaactttttgtttcattgatattttgtattgttttcatttcaatttcatttatttctgctctgttatttattatttcttttcttctactaattttagggttggtttgctcttgcttttctagttctttaagatacatggttaggttgcttatttgaaatttttcttcttttttgatgcaggcacttggagccataaacttccctgttagtactccttttgctgcttttgggtatgttgtgtttccattatcatttgctccaatatttttttcaatttccttctgaatttctttattgatcctctggtcattcagaagcagattgtttaatttccatgtatttgtttagtttctgaaattcctcttgttgttgatttctagttttattctattatgaccagagaagatgcttgatagtatttcaagttttttgaatgttttaagacttgttttgtgtcataacatatggtctaccattgacaatggtccaagtgctgaggaaacaaatgtgtattctgcagccactgggtgaaatgttctgtaaatatctaccatatttgtctttctgtgcctagcttatttcatttaacatgatgacctccatctaaatgtttgagggggtggatatcctaattaccctgattcgatcattacacattggatgcatgtatcaaaatatcacatacactccataaatacgtgcaattattatgtatcagcaaaaataatctttaaaaaacaaacaaacctactgtagagcatttccacagagtcccatatctcctcctttaggatgatttcccttgaacacttcaatggttcttagaaggcaaaagcagcagctttggaagtgaatagacacagattaaagtcctgattctacacagaattatctgtgattctgggcaaagtaatttactcttctgcctcccacaagcctcagtttcctcccctgaaagattgggataaaaacctacctcaatacctctagatagaatgtacacctacagaataactaaataaatccactctttctttcttcctttcctctaacattcaatggcatgtatagtgtttgtcatacaatttaattttcaattacagttttctttctttctttttttgagatagagtctctctcaatcacccaggctggagtgcagtggcgcgatctcagcttggatcactgcagcctctgcctcctgggttcaagcaattctcctgcctcagcctcctgagtagctgggaactacaagcgtgcgccaccacacctggctaatttttgtacttttagtagagagggggtttcaccacgttggtcaggctggtctcgaacttatgacctcaggagatccacccacgctggcctcccacagtgctgggattacaggcgtgagccaccgtgcccggcccaattacagttttctaataagagacatttacatcatggtaatgctttgatgctatatttatttgtaatttattgtgtactaacagattatagctgcagcttatagatgaaagcttagtatttcatcatgagtttcttctatgttccatcaacaaatcctggcaagtagcagcttctccaaggccacctcctttgcatgcaacactctagcacatgctgcatggtttacagctccctgagctcaccacctgctgcctctgagtgtgtgctcatgatactccctcagttttgaagcctgtttctctgcccactcttgcctccactccacctgactaacatatcctcccttccttggggaagccttctctgacctcatcctgtaatggttccctaagcctgtttcacatgccaagtgctcatacacaggtgctcatgacactcacacttagaaactcattttccattttccatgcataggatagtaggtccacctcacctttacccttgtaaggggcctgtgaaacccagcaaatgactctggttcttagccttaggagatattgtggagatggctcactaagggatgaagatcggtgatgtccctagacctcttctctgtatgagtcacattatcttacatcccattaccctaagggccctcccgggagtccacaggttgtgccagcagcagccagctccagccttgctctgctgggtgaagctgggtcagtgtctaacttagtggcctccttggttgctggaaatgggaggagccatcgtgcatcagatgcttggactaaccaagtggggagccaggactcactctgagtggtagctttctaaatctgcaaaaactagagtttccagagccagggaccctggtttaatgtgctgctttgctggagcccgagcctctgatttcccttgttcagctgggcccatgataacttgcctcaatgatgcgaagagaagggaactcagcagatctaatgtgcctgctgctggaacctggctcctgcgtgaaacaggatgacatgcctgttgtagcaactgtcctctgagttgcagttaataaatctctggctgaatggatacgtggttgggattatacctcttgcatttggcaaatccataatgattcaccctcctgacctgtcactttcccagttctagtgagcattcttttctctctgctatttgtctaccttgaacacatttcttttcatgaattcaccaaaaatgaactgcaatttatttgcctgcaaatgcaagcagctgtgagtaccttgagggcagagattccgtctactcatctttacactgggaaaaacaatggaataaaaaatatattggtggccttaagtgtgtgtccagataaacttagtctcaaattcattctgttaccatgacaaggtaagatgagtaggtggatcaattttaaaggttctaccatctgtgcatctcattcatattaacatttgttaacaatgaactaaatgccactttaaagtaatgaccaacatctgtatagtgttttgcagtacatcaccaccttcaatattatctctgttttgggggcatggaaacttattcaggagccaacttgcatggaagcagcacagtatactgcttaagaggatgcactttgaagtgagacagactgaggtttaattccaggcttccccagctacatgacatgtgatttgggacaagttacttgacttgatttagccttagtttctgcatttgtaaaatgagaacgaagatacatacctcaaagcacttttggaaagataagtgagtttatgtaagtacccagaatatagtttgttctctgtgcatggtaatggtaatggtactcttgccacatacctcctagtaaatagaagagctagactaaggtctaggcattccaaatttcatgactcatctattgtaccagtttaatattacctaatagaacagttccccattttaaatttctattcaaaaccaattcatgcaatcaaatgataatataacaaggaatgctcatatttctatcttcatttacaaagttaaaattaatattccatctgtatattcattttgattggaatgcagagtgcctggtgcacagtgggtgttcaactaatgtttgttaaataaaattccctgtgaattctccccttgcaagtgctagacttggtaactgattataacaggagaatatcaacataatttttttggattgcctgaatcaattccattctttctggcccactttagggaaactgtcaatgacgaagaccctaaggaaactcatctgtggtccataaggagatgaatccccatgtctggggcatcatgttcactgtggcgccaccaactcagatgaccagacacaaatgaatttctcatggtactgtggtggaatcagctgttttgagttaactacctaagtgaatgttctatttttcccacttactattcatagaattctttcttttaatagcttttgaagaccctgtaaatcttttcaaatttttgggattaatccacttccactgtgtttccatggaactttgcttgaacctttattttagaacctatgtaattctgatttgtattaaaattctttatgcgtatttctgttctattagatgttaagctcttgacaatagacacttatataatctttgcacagagaaacatgcatgatgggtggggctgggaaggaaggagacaacaagtgagagagaaataaataaagagatgctatattgtgtctactccaagttcaggtattatgccagatgctttatagctatcacaggtaattctcatagaagagaaggatattactttctcggttttaccaaagagaaaacaggcatacagaggctaagcaacttcctccaagcaatgaagacagcaaatggtggagctagaaatagagaccaattctgtttagtttcaaaatccctgttgcttctccatctccatctcaatgttttgcacaagacagaggctcagtaagcattgaaacaagacctgataaactcacttgcaaataggaggtatgtgatcatagctaagcataatcaaatcatttaacagcttcaaagtacttgagcaatagaagattggtggcagcatatgtttgtctgaatacctacattatgaaaaggcaattcagttagatagaaagcaaagacaaaattaatgaattaagcttcatgtagaagcctagccttagttgctagatttgtgcaaaacaatcatcctagcatgctgttaattgttttaaaaaataaatgaaccggtagctattaattacgctttcatacatctgaaaaagaaaagaaaggaaaataagcaccaagatcaacacaaccagtagagaggctggtctgcattatacagtgaggagtcataaatcatgtgtgagtaaactttagagacgatcaatatcttgtttaactcttatgacaactatatagcaatagagcaatattgtttatacagctctttgtcatcttaacattatctcaaattcgcataaatttgtattctccaaaagactatacggtatatattattgcctgcatttcactggagaggaagcagaggttcaagggtgtaagcaacttgcccaaggttggccatatttaatgcaagagcaaagaagagaaatgcagaccgttaaggaactgcttttcttctaagaattttgatggttgtggtgaggtccatggagaaaagttgattactccagtcacattatccctgtctatgctgttccatctttcttctctctctatggccaatgcagaggacccaggatgcctcacatgtgaattcaagaaatggaaaatttcgctttatggtttaacataaacttggggtggaggggaatggggagaatgctgggctatgaacttcttgcactgcctgaatgtcctgacaacttcctttgtatgaatggccattgggggaaaaaatcaaggaaacaaaaaataatatgttatggaaaccatgtggttgcagtttcacatgatgggggtgggtttagggttatttgcttgcccctatcagttagccacatgttgaaaaggaggaaggaccacagactgcaacaaactgaatcaagactggaatgataatccctgacaatctttaatttgctaaaaacttattacattatcacccaagaggctggataccccacagaaaccaggttttgtcctgtgttgaaactgttggctcagatggagggataaaacaaaaagtttgtttggttagaggttgagtgcagagacatttgctgtagcttggtaataaacttgtctcctgcacaatggacagtagaatcgctgaacagctgttgattggtaaattagtatagagacccacatggtatctgtagaggagagacaatttcttttcccttgtgtctttcagacagatgtttggtgttccttgtgctttctttccttaccatctcatttctgacctttctttgtcaactgtgcattcagtgtggggttatcatttacctacctgctgtgcctccatctgccttccaatgcctgagcatgctcagattctggacatccaatgcagtctgatgaggatttgcttttcagagtccttttctctttgtacacaacacatcaaatggcaaatggtgactgtgggacccacctctgcaaagtcaacagatgccaggtaggtgttcggaaaaaagctgaattgaactaggcaggacagatatttgcaaattaaaacaactgctttcctgccagggttttcgttgggtctcgaaaggcccatggagagaagttaattacaccagtcaccttgaatttcttgaatatcacaagagggaaaggtgtgtttttagttggtttctggttccattgtgaacaacaaaaatgagcctgttaacagggcattatgctgcctgcatgctcccatgtatagacaggggtgtaagaactggaaagaaagctgctggaagtgccccttcttcattctaccagtagaaaactgaggtcagagaggctacatgcttggttgaaggtcatatagctaattgtggttgaggtggatgcggagactacgtcattttacccctgggttggcaggtgtcaccccactatattgtattaattttaatttctctgtattgggctgtaagactcctcctcctagtcaactagggttctatttttatttaaaatttaatcatatgatatttactaaataacaccaaagacataaaaccatataagtatcatgtgttatatatctatatatacactacatataacattcaacatcatcaatttccttattctttcaacaaatatttattttgggcctgtgtgcaaagcactggaatagagattgtcagagtttcaaaggtaaatataataaatctacagtggggtgaaaaagttgagaaattaaaaactaaagagtacaacccaggaaatgtagtaattgcagtttaaccaaaggcatttccatgtctgtaaggcaagatacttgaggattttcaaacatgtgaaatcctcactttaaatagggtttattgtaaaatcttagttaactagagggaattatctgggactctcagttgatcagaactgtttttgctagttctgctttgggagaaagagaccacaaagaatgcaggatggcatcaggaaagaggctgggttcacttccagattttccagaagttttaacttctctatggctcagtttcatttactgaaaaaggccaatgtgaagcttcattgtgtgggtgggaggataaaatgtgtgtaaagtacccggcccagagtctgacatacagcccctgcttagtaaatgcttattttcttagatctcatttctaaaaatgcacttcctgaggaccttcctgggcttgatccatactcaaagctgtctctggtgccatctacaccataagataaaacagtgaggaccaacattcgaaatgatggcagcaaggccccaggaactgtagccatctaaacacaattctgttctcactaatgtgttctgattaccaaagaggagcaatggagttacacattttggaagagctttttagccagagaaaaggaaacacatttttggaagggctttttagccagagaaaaggaaacacatttttggaagggcttttggccagagaaaaggaaaaagtatttgccacatagtcaaccagaagatttaatgactcagaatacagtggctacaagaattgtgggtgactgaggttttgttttatattaacagaacaaaggtgcctttggtgcaggtctgtgtttcttggcatcacttcctccaggaggtaaaggacccaagtgcctttactaaaaataatttctcacagatctgtccagtgctgacagagctcagggctgaccccagggaggcacaaggtgacctctgcatggccttcatcctcactcgtggtggtcacagggcatcagtgtcctgggcagttgtaggaaggaataggtgtgagtgtccacatactaatgcttccaaatgtgtcaaatctccctgctttccaaaaatagattttgtgggtagattgaagtgagagagaattcaaagcacaagaaaatcatggcataaaaaaggcacagaaagcagagctattgatcaggagctttattttatagaacggggcttgcagtctggaatgagacagaggtttctagtaaatagcagcagtgagactggaacctgggggtgctgatttttcatccagtgtttttgctgacatctctgtgatgacctggtccttcaccttctttcctaacgccacccgaggacccctaacatggagttagatgttaccgatggaaagcattgtacagagtctgtgttccaatcctgttctttttttttagaggcgaccactgaggcccagaaaaggggaagtgccttgtctgcgatctcatggaagttaatgagaaagcctgacctagatcacctgccctatcatagacccagtgccatttctactgcagtgtgcaaagacttcaaagaaggccagtgtgctcccctcacccccagggattgcaagttcaagtgtcctgtctgcactgtcctgaggccattctaggccattgtgcagagaaatctatattctatggggtgggggagatagggaagagattgagtcaacaaaacagattagtagacctattactccctagtcttagtacttttttaggtaatttgagtaaaactcatgaatcctagagcactttaactttgggttaaatgtaagtccacaacaatagtcacaaaattgtattgctctgggcttctctacctatagttagggtgtctggaactcttcaaatgagggaagtcattctcctaactttaatgtaacatctgtcatttcatcctcttcctctccaactccctgtagtcttgtccattgctaagcccgcttgcatccatgcaaggagccctctactttcacacagaccacccacaaggcctggagaggtcacagcaaagccagctcccacagcaattagagacattggcattttcttctataaactatagaataggtgtctttaaagatgaggataattgttagggtgacctccctaacaattattcagtcattattctcatctttaaaggcctcctttttactgccagaagcatctcatacacacttagatttctagccacagaccatctgccagctgtttctgccagaacagctgcccatcagaaggaagatggaccaagagagcctttgcacagctccagagtgcatctccagcatcagagaggcaggcagccttgtcatgggtagctccagcggttggtggatgacacagccaacttggacatgaaataggcactgagggcattaaagcagcatgaaaaaggatatccagttgtccacacagtacagtgtgctgctgtttctgtggacttcccacggtcaggcttcaaactctatcttgttctaaatcatagcacgcaggcgcatgcgcgcgcacgcacgcgtgcacgcacacacgcacaccccgccctccactaactcatgaggtgacctgacctgaggatcattgaatccagtcgttcttaaacttgactatgcctactgaccatcttgggggcatttagaaatcacagactcccaggccccaccacccctggcatactgaatcagaattatcaagaggtaaacccctccactcccttaaaaagaaaggaagaggccaggcgcagtggctcacacctgtaatcccagcactttgggaagctgaggcaggcggatcacgaggtcaggatttcgagaccagcctgaccaacatggtgaaaccccatctctattaaaaatacaaaaattagccgggcatggtggcatgcgcctgtaatcccagctactcaggctgaggcaggagaattacttgaacctaggaggcagaggttgcagtgagcggagattgcgccactgcacacctgcctgggtgacagagcaaggctccatctcaaaaaaaaaaaaaaaaaaaaaaaaagaacgaaatctatatttgacaagagtagctaatctaccacacatccacgactagcatctaggggctactgatcacagttcaaatatccacccctccctgtagtttttattgaagaggacacagtggctctgggagaggaagtgacttgccttaagcaaagccctgacagaaatgggactacgagactagaaataaatgccttcacctcttttgttttgctccttcgcacaatgcacatgccctgtcccttaatgatggccacagcttccttcctatttttctatattcataatacaacacatggacatttggctgggcaagcacatttattgatcaaaaatatgtaatcctccttccttatagaagctcaggttccttctacgttatttaggtgggcacctcaaggcgctaggaagaccctaaagctttagagatcagcctctgaaaatgtatgaatactgttgtgcatgtgcatctgtgtctgtttcaggcaagaaattctgtaactttcatacatgcccaatggcatttatctacatccctaaaatggctaaaacttctggtttacaatatccctaataagaggctactggtttgaaggagatggtttagaacacacacaaaaaaaatacaaaaataattttacttgagagatgcagcttaagttactcctttttggcacatctaactgtgccaggcatagtgaaaatgattgataaaatgtcaagatagaaaacacgatcataaaagctaatgcagcttgagaatttttttaaattggtttaaagttgcattgtcactagtgggaagcacaagtatggccaacccaaaaggcctcaaggaaaaggcaagagaagtcagagaaggctgaagacgcagacttggagggataataaaacattttatcagggcaggacttgagaggaatataaagcagtaagttttaattaaagttatgctagtacactaatttgggcaaccaagattcataattaaaattttatgccaactctgcgcatcaccaaacatttttaatggctccaggaagaacatgatgtgggtacaggatacattgcagtgaacatcaaggggagccagtcaaatgcacagggtggggaaacagtggggagtagctaggaagttttgtcccacaaactctgaaagctttcttctgaaaaatgggcagtcatagctacttggtcaaaggagtgtccaaatgtcttttgcaacacagcaaagtaccacttgctggtacttttctgctttccccaattcaatatggttcttggaaggcatgaatcacttctttcatctttttatcctcagtatttaagacactgtcttatatcagttatttagttccttaacaatgctgcaaaataaataaccataaacccccagtggcagataacaatttatttagtttataagtctttgaggttctggtgattttagctggatttgctcatgtttctgtggttatctgtaagtcatctaggcagctctgctaaactcactttgtttgctcatctatctggggatttactggctgttggctgatctagcatggtctttgttgggatgatggggcaacttggctctccaccatgaatctcatcctccaacagactcccctgggtacaatatcctaacatttccttggccacagcaagtcatgtggctaagttcagggtcaaaaggagagagtgctaccaaattatgtggcaaagagtatgaaaatagaatacagtaaataattagggcctttgatgaaataagtctcttacatgactagactagggtaaaggctcaataaaagtttgttgcaaaaactgagtatattatccaaagaagatatacaaatgtctcataggcacataaaaagaatggtcacattaataatgatcagggtaaagcaagttaaacccacagtgagatgccatttcattcccactagggtggttgaaataaaaaagtcagatgatgacaagtgttgatgaggatgcggagaaactggaagcctcatagactgcttggagaaatgtatgttggtgcagccactttagaaaacagtttggaagttcctcaaaaagttaagcatagagttaccttttgatacaacacttccactcctaggtatatgcccaagagaaataaaaatgtatgtccacacaaatgttcataacatcattagtcataatagccaaagggtgaaaacaacctggatgttcatcaactgattagtagaaaataaaatgtagtagactcatataatgaaatattattcagacacagaaaggaatgaagtaccggtacatgctacaacatgaatgaaccttgaaaacattacgttaaatgcaggaaaacagacacaaacggctacgtatgattccatttatgtaaaatgtctataataggcaatctatagagctagaaagtagattagtggttgtctaagtctgggtgggtcagagggaaatgggggtgacttctaatgcatttcttaatggagtgattaaaatgtttgaaaattgatcatggtggtggttgcacaactctgtggatgtacaaaaaaaacattaaattatacacctgaaatggaagaattttatggtgtctcaataaaccttctataaaaaaacaagaaccaaatgagataattcctttaaagttactcagcacagtaccttacaaccttggctaagttaaccatacttcataaaatctatgatgctatagattgtaagagacaccattatttaatatacaacaagaaaaacattaccaagttaactatgacagatcatcaattataagacatatcttaattttgaagatgttaaaatatggaaaatgtatattagaatcaatgaattatggcatgtgttgaagaaatagcatctgaagttaaatctattcaactgagtagatctttctgtcttcagattccatttttaggctcagatatctttcctagattaatggattttgggggtatccacctttgactcccagccttcatcaaattcggcaggtgggcccagaagaagtacttgccctctctggtcctacctggtgctctgtcattccccttacagctctatcctaggagtgcctggtctgcctgagaatctcttgtgtttttgtaggcatggatctctgagtgtggaatggacctgcctttccctcagggactggaggtcacttctgcctcccaaacccttcaagcatcttctctctctcctatgatgggatgtgatgaggataaacaaggaaagtgctttgtcgtggcaagagacatctggtccccagtggcagcttccacagagaagagagtgtaaaaccacacacatgttcactttcgtttgggtgaggagtagtcagagctgttgactaacggacaataggatgcatgaaaggtccacccatccaacttgtggtcgtcagtaaatctccagtcgcccttggggactggggagaattattttctccctcttgcaatttacaagtatcatctaggaaagataagacagtagcttcattgttggcaggctgtcatgggctttcttaacagcgtgagtgtgctttctaattttcacactagaggaaaaaaattaaaaaaaaacaggctcttcagttttgtcttccatatacgtgaatcttatatgggctgtagaattgttctgtggggacagacaatgaaaaaaaaaagtgtgatcagataccttcctcagaaacgaaatctagaaagaagagtaagcagtgtggtagatgctgtgtctacatcactacagttctcttccgctggcattttgttctggatgattccaggtgtagagcagaacttcatgaaaattatagtgcagtaagaagaaggcattctagtgccagacaacccatgttttatgatagggatctaacccagtgacaccaggaagtctttgatcatggtgcgtaagttgtgtaattcccatagtggttcttgtatttgacacatgtaagattttctttttgaagtctcaatttcattaccgaagacactgctcagagaacaattactgatagaccccaactgaagaagcttcctgggaaggaggtgcagggtgtggtctagatgcctacagttgggtatcatgactgagagacggcaaatagcattattcttcatctgggttccaagtggtggaaagtgactgcttggcataccctgtgaatgattctgaggctgctttagaacttcaggtggaaagccaactattactgatcatgcctatctatggatttagctagggcttggggtagagttgagttctgcctgttacactatgtctcattaatttcctctcagggagacagtatcctagcagggaatgatttggaatcaggcacacctggtttccatcctggttctgtttttcatcacatgatagtggagcaatttatgtaatctccctgaacttccattttctcatttgccaagtgggaaagagctcactctgccatgcactctccaaaaaggctttgtctaactcatgtgatcttcataaatgcctggcagagtcaatacctggaatctgtagaagaaagacacttttcacatggggaaattctttcccctcaggctagtgccttcagaccgagtctaatgtactctgcaggctctgcttggatcatttgtgcctgatgtctgaaaaaaaaaaaaaaaaaaaaaaacaaccagaagcactccctacatttgagaaaaaggacatctgggaattaatcctgaagttgggaggaaggttgctgagtctggattcagcctgaggggcagatggctagggatgtccccagagtgtccccacctccacttcatgtgcagatgacactgacagctgtggtgaggaagggccttgccatgtccatgccatactcattaagccatgatatctaacagccaacagctctgcaacctgtacctacttccaaggagtcaagctctatctgcttccaggctctgctgaatctgcctgtatttaagtgccccatttctttcccagaagtaataaaacagtcatctcgttgacattaagtgcggagtagcagacagcaagactcatattccaaaatctcaggaccctgccagttatgacaagacactcttctggctacagaattaacatgctactccgggtttaaatggggggattaggctaacacagagcaaaccagtttcttccttattttccctgacatcacttgagatctcccagaaaatggatagttttcaactctctgatttgtgcgcaactaggatcatcttgcaggaaggctgttcaaggagatgggtttggggtttctgccttgagaagctgataaggatggggttttctgcctagcgattactgtagcagaagtggccctaccttccatcctcctgcgatggggcctccttttcctgagcctttactgtcccaaagtagcagcaggactggacagctctgcccacagcatctcccgctcctgcattcctacattccaggcctcagctggagactacactttctccttactccctcttctctccaaatcccggcttctcagtctctctcctagacttgcaatctaatatagccaccaaaaaaatgtctgcctattttgaaatcatggaaaactgttggtttatttctaccttttttgggtggtgtgaaggaataagcaaagaaacactacattttaggaaaaggagaaatgtgtacaatgctgatttttaagttccagctttagtcagtttaggagcataaggctatcctctacgactcagtttgctaattaagtggtgattggaatattaaattttaaagtataatttagtcagacaataattaccagcgaactaattaaatttacttttcaatggttttcactttcaccgcagtgaacctgtaagttactgagctgcaaggaatcgagcatctttccttttgtcagagaagaaaaagcaggcaaagcaatgataatcaaagagtctttcttctacgttgtatttcgtatgaattgtgtagtagttaagtgcataggcccaggagctgagctatttggttcatggtatgacttggatactcactggccgtgtgatcttgaccaagttgctaaacctctctatcccccagtttcttcatattaattagtgtccatctcatagagtcactgtgcataataaattatttattatacagtttatagaatggtgcctggcacatatttaaatggtaaattagtcctatctatgatgatttttaacaatctttgtgctttctaaacttatctccttcaatgtcaagcctattaaaaaatacaaatttctataaattaatctggaggaaaaaagagaacaagaaaagaaagtcattgataacacctgccacacaaaattagccaatcattcataaattttgacctatcactgtccgcatttgtttccaatgcttctctttcatcctcttcacagaatgctgctcgcttactgagctctgagcaagttccatcccatcttgcttaccttgctctccccacaagatcctctcagactagactctccttttatttattgggtcttctcttttgaaactgctccctgtatctcattcatggtcaacttttgacttcaggtcagacattttgttttccccttattgaaataagtctctgtttctattaatatagactcccagtcttcactaagactctgccttagtttccattttcactcttgcagcttgaatagagcaccaaagagaacaaatgaatgtgcttttccaggagaaataaagttacacacatcccactgaaaatggaggagggggcctgaaaactttctagctcatttttactaattaaatacgtatgtgatgctatttatattttattatttagtaacttgtctttgttttattaccttagagaatgcaaaatcaaccataagggttttaaagcatagatttatagcactttctttaaccctctttttgccagaaggtcttaagttccttaattgcaaattttcccactttgagggtggagaactagggaagggagagacagtacttttcctgaactttccattccatattgctgggctcctctgtggggcacctgcatttcctgagtctgaggtctttccacattgccttgcagggttatgtgactgtcttgctgggacgcctggtctcagcggtccctttcagcactgtctgcatgattttcacagaaacatcttagttccagctacgtttgccactctgggcagttgtttggcaagcatgccatgttaacatgccatgttctttcatgtttctgtgccttagtgagggctttccttccatcttccactattctattcattaacttaataaacatattatgcagctactgtgtgctagcgattggggattcaaaggtgattgagtaaaagtctctcccttaagggagattttattataattcctgagaaggacaaatactgagtaaacaattgagtaacgaagacaattacagtgctgtgaaggcaataaccagggtgacaagataaggcagtggttctcagctgtggctatacatcagaatcctttggagaacttccaaacttatgggtgcctgggccccattctcagatcaatcaaatcagaatttctgggaatgaggtccaagttctagtattttaaaaactccccaagaacatttttaaaaacagttttattgaagaataatttacataccataaaattcacccactgtaagtgtacaattcgacagtttttagtaaattgcagaattgtgcaaccatctccatagttcagttttagaacatttccatcacccaaaaagcttcctcccacccatttacagtaactccccactcccacccctgggcaaccactgatcttctttctatagatttgccttttctagacaattcattccccagggagtttttggtgtagtctggattgaggacctttatgactgagcaaatgaggaagacagtggtgaagttagatctgaaggatgagaacaaaccagctgtgcaaacagtgtgtagaagagccctctggcagagggcatagcaaaggctagggcttggaggaaggaaagagcttggcccaggagcagaaaggaggccgctgcacttaatgagcaagggtgagagtagagcaagagtcagggtccagaaccttcagagctttgtggtatggtgaggagcttgagttttctcccaggagcattgggagatcactaaggggttttacatagcagtgtgacatacctcaatcctcatttaaagaattgagcagttttgtagagactatattagagggaggagaaagagggaagcaggaaggtcagttagaagactagttctatgtggctgaattcagttcattctttaaggcctgattaaatgtgacccattttgggaggctttctcagtgttcctacttttgcttccatagagctcaatttacactttcattaaaccaacaattatatgcaatcgttaataatctgtttacatgtctatcataggctatcaactcgtttggtggattgcatggggaaaaacatctcactgaacaagtaaattaatgggaaatacaataaacaaataaaaatgagaaagaaaaaagaattatatgttgtttttccttctatttctagcacttggcactatgcctggtacagtaacaggtgttcaggaaataaatgtttgttgaattgaatgatgcatctcttcaaggatcaagaccatgctttatgttttgaatccccacaacaagaagcataatttaatgtacaaaataggcaatgcataatttcatgttgcatacatgaatctaccttgagactgaattccatcagcacaaggaatataatgtgtgataataatgtatagtattcaaagcactttccttcattggggaaattgttgctgagcacctataagataacaggcattatgttatgtggtgctggctagtacctggtttaacaagatagtaagagttcccttgagagtgactgtggtcttgttgaaggaagctaaggagcaggggatcatgtaacaggcttgaagggaagaaagtcaaatttcattatccccattttacagatgagaaaaccaaggcagattaaagtgcatgtctaaggtattagttgagatgcaaacctgtgccttctgcttccaagttcttttgttggctagtggctcttggaaagaaatgccacgtctgggacacttgggcatttccctgtagaaagcaatggttgtctctaggaggcacaccatggtgaacgcttctgaagcatggaatttgcagctggaggagaccctggagagcatttgctttcgctgctttattttatagataatgaaactgaggcccacagaaatgaaaggactttctttcaggttacacaggtatttagtcagaaggccatgcattctcagagtgaaaagcccttattcattttattgttaaggaaatttagaaccagtgacatgaaatgatttgtctaaaatcacacaactaggaaatggcagaactccaacaagaacttaggtcctctagctcttagatctgttttctcaccactaatttgtagaacacttaaatgcttatatctgttgtccaccaaaagacataaaaatgttcatgccaccttttttaataatagcgcaaaatagaaataacaaaaaccttcctaagtggtagaatgagtgcttacattgcggtatggtgacaacatggaatattacacagcagtgaaaaagaatgaactactgcttcacaaaacaaacatgggtaaatcttaacagatacaatgatgtgcaaaagaagtcagacaaaaaaagagtccagactacatgatttcacttatgtgaaattcaagaacaggcaaaatagtgattgaggtcttaatagtgccagcggctatggctgatggggaacattagtggaaccttgcagggtgctgggaatgttctgtgtctggatctggtggaggtaacataggggtatcaacatggataaaaatctgccaatatatcctcttaagatctgtgtgcatttctaaatgcaagttatacctcaatagatgtaatgaatgaaaaataaagtttccactgtcatatcccattgttctcactacagatctgagaggtaagaccaggtttaagaatattaggcttagggaatttgctgaccaatctcacagcccagggaacatgtcagcctagccataagctctgcttgaaaaagctgctggttttcagtcaattgaagaaaggttttaaagtttcttagagagtttataaatgtgttaattacagtcatcaagattttgtattgcaataaatgtttatctaatgggtttaaattaggcaatttactcaatttgcttgttatttcctaattaacttctgaaatcctctttctctgacttttcaacctataccaatagagtttggatctaagaaattttattttccttttagcagtacgtatagctttttttcctttttcttgtttacccatccaaaagttctacaggcaatttcaaatgtacatctgcatctctgtttcttgaacttttgattttgttttgttttagggcaagactccttgtccctagaaaagcttactgctattatttacaatagaagctaatagaaagcaaataaatgaccaatgacaggaaaggctcaagtgaactataatgcatctgctagatggaatataatgcagccattaaaatacaacaatagcttggaaagtgcctataatattgtaagtggaaaaagcgagcaaaattgtccatatagcatgtctcaactaagcaaaattacacatgtctaaaagtaaagtatactaaatgtcaacaatgattacgtttaggtaggagaactagagtatattgttattttcctacttttctgtatttcccaaatttactttaaagaatatgcactatatttataatttcaaaaatgacatctttgaagacaaacaaaattcattttcaatatctttaaggcttcctttctaaatgtattctgtttttcaaagctattgagtttctcatattactaataactttatagctttaaatcagtaaactgaagtttattaagccctgacttggcatctagatcttctcatagcactatgagacctaaataaaaaaaaaaaatacaatgatgcaaataaaaggaacaaaagtgatagggaaaaaatagaggctaatgtaagaatgaaaacagtttattttgacctattgcttattagacccttgaaatcagttttctcataaacactccctgatgaaggtagatgtgatcattcccattcatttattccacagacatttctaaacacctattatgtgtcaggcactgtgttcaatgctggggttacaaagataagtaacataccaacattgtggctatatgtcatttataccaaaattattatacctaagaaaagtatagccctttatctcaaggaagcttgcccacagaagagatgcaaaaaacagattcagaaaggttaaatgacttgtctctgtcccacagaaggacagtgctagagccaggatttaaattaagatctcttgggctttactaacatgctctttgtagcacatccagcagcttctctgcaacatcctggtatcgaggaccatcatatgatacagacgacggatgctgcaggactgacaaactcctcagtagctggcaaagctttcctgaacaatggaggacctcactgggctttatagtgggtaagatttagatatgtggacatatcggggaagatattaacagcaggcaggtgagaatgaccccatgatcatggtgctggggtgcagaagggaaggatgtgctgggttgaggttgggggtgattttccttcagtgaatcacaactgagtccagtgaattatgtcaaatataatgcaggggctgcaataaggaatgacaaagagctggcctttgattcctcagatattcattaaacatctatatttggttgggggcaaggaatgaagtgatacatataagccatcatccatcttggaagggaaatgggtccataatcagatcatgaggccaaaacatgggacagaatgctgtcatttagctttcagcctcaaattgtcacctctgcagaaagacccggtctgtagtagtcatccagtcatttcccatagaccccaatcttaaatctatacagaatattgatcaacattggttatgtttctcagtttgtcacttttaaacaaaagtgattgcttatctcttttcattagaatataaaatccaagaaagcaggaaccatgtctgtctgatttctagctgaattcttagatcctcaaacaaagcttgaaaaagaaaacattcactaaatatttattgagttaattaagtgatttttttggagcaccaagaagggtttctagcctggacaggaatggggcatggatgtcagagaaggcttcctgcagaaggtggcagtgagatgggccttaaagtatgagcaagttctgtatggaatcagggcaagagcgagagggctgagggaagagaggaagggcattccaaggcacaggcagacaatggtggtgaaacgtgctatgcagaggagctgggaagtgtcaggcaggacttgcctaaagatgcagctcaagaagaagccccggaagcttccattttatttgaaggacaaaggagatcaattggagagtttgtaagtggagatatgacatgatcaaatcagcatttaaaaaaattcagcagtatggaaagacacattagggtgacacaagattggggatgaggttccctgttgagaaaaagtggccccttaccctccaggagctgggctgggactatcagccaggacttgatgcttgcttgatcaaaataaatattttctccaaccacaccagacaaggccactgcaattccaatgggtcaagtcaaaaaacaagatcaccctataataatttctgaacacaggttgggcacagtggcttacgcctgtaatcccagcatggcagattacctgaggtcaggagtttgagaccagcctggccaacatggcgaaaccacgtctgtactgaaaatacaaaaattagccgggcatggtggtgggtgcctgtaatcccagctagtcgggaggctgaggtcggagaatcgctggaacccaggagggagaggttgcagtgagccaaggttgtgccactgcactccagcctggatgacagactccatctcgaaaaaaaaaaaaaaaaaattctgaatgcaaacaaaaagcatgaacatcatccacactataaaaatgaccaaacagtcccctttcttggctaatatgagtggctgatttttttattatactttaagttctagggtacatgtgcacaacgtgcaggtttgatacataggtatacatgtgtcatgttggtttgctgtacccatcaactcatcatttacattaggtatttctcctaatgctatccctactccagccccctcccgacaggccccagtgtgtgatgttccccaccctgtgtccaagtaatctcattgttcagtttccacctatgagtgagaacatgtggtgtttagttctctgtccttgtgatagcttgctgagaatgatggtttccagcttcattcatgtccctgaaaaggacatgaactcatccttttgtatggctgcatagtattccatggtgtatatgtgccacattttcttaatccagtctatcattgatggacatttgggttggttccaagtctttgctattgtgaatagtgccgcaataaacatatgtgtgcatgtgtctttatagtagcatgatttactatgatttattagtaatggtttactaattacagttttaaccctgctgcattcttccagctgtgtagataagatttactaggatatgcaatcttagaactagccccatttcctgacagcacacagtccagagtgaagccctgcttccttgaactgtcctccaaagtatctaaatctgaatcctgtaagtccctcctagcacctcttgctgatatgcctcatgatatctcacactatgcattgtccctcatagaaacagcaatacactcaacctgttcaacagcagatgtgttcctgcctttgtctggaaggcaatggcaccgctaaaaggttgctgcagtcactaatatgcggaagcccacctgtaccagctcatgctgattgccaaatttttaggaattttgcaagccaagtattaaacctagcactactacaaattaagttatataaacttataattgaagacatttaaagatattaaaaacaacggtaatacgtttactaattcttttcataattttacgtttttttctggagtacattagcattggttgcatctatatggtagagatagcataaaatggtgtcctactgtgcatctgtttccaatcccatgtttagtgtcatcatgttgctgtgaaattcaccatagtgaaaatatttacaccactgaaattggcaaacactacaaaccaaggcttctgctgtgctttctccagttgattggtaaacatttactagcaccccactggctacactaatccatggatgttgaggccttgaagaagatattgagagcaaagctggagatctctggatggattcaagaaatgtttaggtgataaggtaattgatggagaaggaaattaattatctaaactcttctcctgccctctggtataaaaagtataagcatcagattttctttgtctaaggagtcctatctttgggcactgagatatccttttgtaatgctgtcctgagtcccacctgctctcaggctgattgcctgtctatggcttgagtacaaggaaaggcaagaaatagctcaggggaggattgctgacagcactcttggagtactgatgagagccatcaggatgaggggacctgcttaaccatctcccaaatagctccccattttcaactaagagaacagtcacaataggtgagccttccttttatgtcagggtctgtttagaaatacacatgatcaggttatttatttactttaaaaagttcaattggcattaaaatttcacttggactaaatcggataatagaagaagcacagagtgaacagaaaaagcacaaggtgaatagaaaagagggtcatagataacagattaaaaattataccaccaggagaggaacaaaagcactgtgctctgaaggaagcagcttcctctagtgatggtatctggcacattaatagtccaggtaattaatggttgtaaaacacttcaaaagcataaagcactgcatcaatgctgagacataattgtgccattatatcagaacgtggagcttcagtactgcacacctacggtgcaggtttttaaattgctgcagtcttggcataaatccgttggcttccatcaggcgctggcctgccccattcacccaggctgctgtaaggggccacgcctgtgcttacatgtgaaataagaagtggtcagcacatgcccctcctcccccatggagcactttcagatgatcaggacctgttcagaactccagtaactcactctcaggtgaccctaaggtcagtgttattttccatggttgtttgcatgtttcacctgaaggtctaggatcattccacctgcttctcttgccttctgtgaagggacctgcccatgagagagagctggagctttagtggattctcgataaagctgtgtgcaattacacagtgagggtgaaagctttcccctccgaatggctccactcccacactagaatcctaatgtcccataggatataccggcttttccaaccactcatgggaagcaggtattataaaaaaaattcctactttgtagataggagaataaaggctcaaaaggtcaagtcaaatgcagagggctcaagcctagctctgaccctaaatctagcactctttcttcaatgtttccaagctctcaggtggcttatgccactgtttaattttctactgccttgtttcctgctacagtcaaaatcataaccatgccaaggacagaacccactgacattgcagagagtgcttttccagagctcagagtgctttggtatttgtcattttaattaatctggtctgtgacttcatttctagctgcatgatcttcggcaagaccttaacctcttggggcctcagttacttcaattgtcacattcattaactcaacattgaagtaaggtgggcaaaattttattagtattaaattattaataaatatgcattaataatgacctcttaaacttttataactcttcagagtttacaaagcactttctcaagtgtcttcttaatctcttcttccaacagctctggaaggtcgctaaggcaaatgttactactccagtgggagtgtgaagaaattgaggcctagaggctccagaggcattttatataaaatgtgttttgggaaaatattagtccctcaagatactctatgaagaaatgtacgagtgggaaatgctatgttgcctacttagaaaaaagggcaaggcaaattaaaggctgttgtaagtcctgcggtaaggaaacctgcttaattttgtttaaatatgtttgctgaaacatataaccatgaaagagaaactgctttctctgaacacctattaatatttcataaaactaggttttctggtgctcctgttccatggaacccttagtataatcaagactaagcaatttgatcaaggtcatgtgcctggcaaaaccagttcttctgtttctgagtcaatgtgaaacattttacagccctctgtccataacaaatttaacaaccttttttgttcagtttcctagctgtttttgctcagtggagctgggcaaccactccaacccccattaaattccacttgttgccaatgaaatgctaagttacctgtactgagcaaatttcacatcactgtgtagctggcccagattctctcttgtctctcttaaacatccggccaaaggtacaggggtgggagttcagggaaaggtgtagtgaaatttctggtgtcttgttggcttttctttctgagttgcgttgaacattccagagacagtactaaacaccaacaattaggtaaagagactaaaacagcagtgctcatctagaagcagctccacccccgcctcctgcctggggacgtttgaaagtatctggggacatttttggctgtcaccccaggtgggtgctactggcatctagtaagcagaggccagggatgatgatgaatgccctatggtacaagggaaagccttctacaacaaagaattatcctgcacaattatcaaaagtgctgatgtgaagaaaccctggactaaaggaagtgagatggtttgggttgcgtgtccaattattgaggcagcttggattactgaagacagcattgttccgttgcctgagagtcagtgttcaagccctgcttcaccagagtgagaaagacttctggggctcactgccacatagttctcctctaattcctggtacagataaaattcatacagtgaactcctccctgcctcttaccatggattggtagagtcctgtcacttagtgcctggcagtgagctgcaggtgaaatgatcaggcccctaagccatccatgagaccttccatccatgctcctttttaccatctgccggtaaaatccaggggagaattctgaaatctgactgagataatgaatcaggagttcttaaacttaagtccctagatccccaagaggtcagtggatactggaatttgagagagaaaaaatgtcctctttaaaaatttatttttaagttttgcaggtacacagtgtgtgtgtgtgtgtgtgtataaaaatatataaatataatgggatacacgagatgttttgatacaggcttgcaatgtgaaataagcacatcatggagaatggcgtatccacctcctcaaacatttatcctttgtgttacaaacaacccaactacactcttgtagttattttaatgtatacaattaaatttttattgaccaaagttaccctgttgtgctatcaaatagtagatcttgttcattctttctaatttttttgtacccattaaccatctccacctccccccggccccctgctaccctttccagcttctggtaatcactcttttactctctgagtttaattgttttgacttttagatcacacaaataagtgaggacatgcaatgtttgtctgtgcctgacttatttcacctcacataatgatcttccattccatccatgttggtgcaattgacaggactgcattatttttcatggctgaatagtactacactatgtatgtgtgccacattttctttatccagtcatctgctgatggacacttaggttgctccaaatcttagctattgtgaacagtgctgcaatagatatgggagtccagatatttcttcaatatactgacttcctttcttttgggtatatacccagcagtgggattgctggatcatatggtagctctgtttttagttttttggaggaacctccaaactgctttccatgaaaaatggcctctttattgtcactaacctctaattgaaagcatttttttcattatgaatgtaagcaccaactattgtagtgttattggtatccacaactaattttctaatacaaatcagaaatacttattacatcaactatctcaaaatattatttttactcatcactactttgtaattatagcagttattggagcagctgaaagatcttgttttataatgcattgatacagaagcacacatattaccatattacaaatttgttgtatattttattcaattacaaacattattcagagaagggtccatagccacaccagactgtcaaagaggaccacggcacaaaaatattgagttgctgctcttggtggaaggagcttggttcctggatgactgcatggagcagagtcctcccttccaccaaagtcctgtcatcccacattgggctatagtataagcaaggaataagcctttcttgtgttatctactgagatattggagatgtttgttaaagccattagcccatcctgactggctgtaattaaccttgccaaaccctttaattgttctgagctttggcttccaaacttgctcttagaaagaatcttatccacacaggatggctgggaggagtaaatgggagaactggtatggaaatgcacaacagatgaagggttttttatggatcatcaagtggggctgctttttccccaagccagaggtcaacaaactaccatccacatgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttttctcctgtaagtgatggtggggagggatgcatggcagactctttatgcagataaaaagcctgggaggatgctaccctcctcaggctcagtgggatgcctgaagctgggcacaagggaacacacagcatgcctgccacctacgaacactgggccaactgaatttaaagccagaacctgtagcccctttgtcacttgcttgaactagttaactgtatcgatgcatacatgggtttgtttcctttgatgaggtaggccgacatcctcagatctagaaggcatgcatggggcagaagaccaaagctggtttgtcccatatctttgcagtggtacatcccttcatatcggtaggtagcagtgcagaagatatgctcacgcccagtctacagataaggaaactgagtcacagaggggttaagggaatataggaaggaaactaccatataaagacaagcatagtcaaagaatttgcccaccgtggtgtaattagtaagtggcagagctggaattgtaacctagcttgattccatgtccagcagtctatacaacccaacattgctttctccatcattttcactgctgttagtatcatcatctgactgcctttgtgtagtgtatgtgtttgccaagtatagctgtgacaaggctgctgccagaatggtctttcaagtgatacaagtcaacccttgtttatctctgctgttgaattgctgtgtgatcctaagtaagtcacttaacctctctgagcctcactccattcaactgtcacgacagaattgtaatccttatcttacctcactttgtaattgggaactcatttaaataagaaaggaaataagttagctgagtaaatctttcttttttaagtctgcactaaaagaaagttatttttctttgcaatattcacaaaactgacagctgccaaaattagcatctgactctttttatttaagtatatcttatttgcttgtattaccgcagcacatcgtagaatgatgtcctaaatgcccttccaacgctggcattacatctttctaaaccaacccttcttttagctgttgaagaaacaagcatctagggaggcaaaaggatttgctttgtgcctcctaggaagtatgagctgagactagaactctgatccttggttcctagggccctgtgttctccacactacttcactgactcctgaaggagggatcgctttcgtgatgatggttctctgagtgcagaagtcacacctaatgtgttccttttctttcagggtagatgtgcaacattaaattcaccagctttggcttcagaaagacctgggtttccatggtgcctctgccactgacaaaccatgggatattgggctcttttatttccctcctgcagattcttagcttctccatgtgtaaaacaagaataataatagcccttacctcacgggtgtcaagaggttaagtaagatgatgtggataaagcatgtaatgaagtccctggcatgtagtaacactataaatgcagctgttatcatagttactgttttagctgcccaacataaggctcccacatcaaaagcctcctttgtacaatttactcatggggcaggaaagaggctgtgatgtatcatcctgaggtccataaaaaggatgctaaaaaaacaagtcataagcaaccatggctatctgcccagttttataattgagaaaaacagcatcttagaaaatcactgctagtttaggtctcttgcttggaattactaaatgtgaatttaaatatgtatttattttgtgtgctggtgtcagcaagtgtgggtactgaggaaaccatccatatacactttaaacttcctgagttagatctcttgtggatgccttctttctggtcaagcgttggtattggccacttgatttaatctgcacttggggcagcctccttcctggccacagagctgatcctcaccttggtggctcccgagatccatggcaccacaaacccttactatgagatgtcttgaagcattaagctttgatgaaattatgcccaggaaacaggcctcttagccactgacagaggtcacaggctcgctggcttacacaaaaccaagctcttggcagagccctgcagggatgggagctgtttggggctaattagcctcattaagaaactgctgatgagctaatggaactgaaatgtggtcaccttctgaagtcacctagcagatttgcagcctaaaaataaagtaactttccagcagtttcccaaggccccaaagcctgtgctcatatttcttctaagaggaagtagtgcaggtgggattctctttccagctgggccagagcctagaacacggaggggcttccagtccagtgaataactctcccctctcttcctgttgcctccagactcagcctccagagctctactcaaatcctgctccctactgggaaatgtatgctctctgtctctgtctttctctccctctgtttctcgatttctctgtctctgtctgcctgttcctctttgtttatccccctctctgtctctccctttgtctctgtctctgtctgtccttgtttgagggtttactctgtgctgagttcccatatacattttctcacttaatcattataagaacctgatgaggctgttactgccattgttcctgtaatgtagatgaggcacagagaggttaaatgacttgtcccaagttccacagcttgcaagttgccagaatttgaacccaagaagtctgactccagaacatgaacctgagcgccgcccccccccccccaggtaatacccccttcaactgtgagttcttagaatgttgtttgcacctacacaatttcccactccaatgcgttcttttcttgtgcatgtacagtgaacctccccaactgacacacagtgggtattcagtcaatgtttgtcggatgactcatggggtataatcttctgaaggcaatgaacttgttttataaacctggggattcccctacccccccccccccgcccgccgattttcctgtacaaagttaagctcctagtttgaacctgttctctctttctatcagatagtctttttattgagaaagttctttctcatgtctagatgaaatctctgacgcacaaacccatttcctgtattctgaatcatatttgaaaatttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatctactcatttagagcacgtcccagaattagtgtgagggttatgttagataatacattgcatctaacttgtacatcagttattattcttaccacaaactggatgcagaagtgtttctttttggtagaataactgagcagtgatttattttggatagcaaatccagtagaaatcttgaggattgttaccccaggtggaactccttagtagaagagctgtagctgattaatttcttcaaagatccatgctccctccctcccttaattcctccctccctccctccctccctccctccctccctccctctctcccttccttcctccctccctccctcccttccttccttccttcctttccttcctcccttccctccctccctccctcccaatatttattgtgcaatgccaggtactagatgctaagtgctggatattcaggtgctagatgctgggtagatgaaaccaaatgaaaaagctccttcccttcatgggagcccacagttaaaaaggaaatagagacaggtgaatccctaaccaccttgaagtaggccaagtgccatggacaggtggaaagagggaaagtcaatattgaacgaccatccactaaaccttggaatcatcactgactcctcagtttctcttatatcttgcagtccatctatctgcaaatcatgccagctttactctcaaatacatcatgaatctgatcatttgtcgtctccccgcagctgctcccttggtccaaatgattaccagctctccccagaactaatttgaatagcctcctaattggctttcctgcttttacattcactcccatccagtctagtctacatccaggggtcaggaagaacttgtaaaaactgaagtcagaacatgtcactcctctgctcagagctcctcagtggcttctcatttcactcagtgtaaaatctgaagtcctcacaaggttctggataatctggtcctggatactctctgctctctaccttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatgacctgtggtcacccctttccagcccagcccacacacatcagcctccttgcttggccctgatgacttccagcacacactcacctgagagtttttacagagactttgacaccaatcctggcctagactatcctttctacagatatacacatagatcatccctcactttctttaggcctttgctcatatctcatattaaaaaccccatccttggccaggtgtggtggctcacacctgtaatccaagcagtttgggaggctgaggcaggcagatcacctgaggtcaccacaactagcctggccaacattgaaaactctgtctctactaataatacaaaaattagctgggtgtggtggcgtgtgcctgtaatcccagctactcaggaggctgagacacgagaatagctcgaactgggagggagaggttgcatgagccaggatccaccactgcactccagcctgggtgacagagcaagactttgtctcaaaaaaacaaaacaaaaacaaaaacaaaaacaaaaaaacaaacaaaaaacaaaaaaaccatccttgaccacactcactcattattactacctgcattctcccattattactactctcctgcttaatttttctggacatatataaattgtttaggtgtttactgtccttcactccattagaatggaatctggtttggttcagtatttctagtaactgtaacagtgtctggcacatagtaggtactcaataaatgtaagtaggaagaatgtgtagcatggtgcactagagacacataaaagggggcatctaactggacttggtcatgggtccctcttggaaatctgctctaggttttgaagaattgaaaggtgttaggcaggcagaaaaggagggaagaaggtatttgatggggggtccaaatatcatgtgagaagactcaaacgaatgaaaggtcatgattcatttgtgaaatttttggtgcttctagatggaatgacagccagaatccttctacaatggcctaaggaggagacacagccttactcaactgccctcccccacccacttttgctgcttaataatccactagaggttttatcaacagagagattttaaacatttccccaagccctgccttttctaacctgggcagcgctttatttatttacttattttacttttgttttcctttttgtgttttctctgatttttaacagacatcgaaagtccagatgaagaagagggatctttcctttctttacatgttgctgtgctgaaagccaacagccaggaaaggagttagcgaaatgcccaggcggtcacatcagaacctcagcaaagggccacatggctgggccaggacagatcagcagactccaggaagccacggtgggtgtatgcactcaagtcactgcagttcagagtaaggagcagccctccagttccagccaagggcgacggctttgctggtgtcctctactcgtggttggacgctgctttggaaaggaatcatgttcactttggataccaactgccaaggggctgctttccagttctgcccatcatttttactctcttctgcatatctgggttctcctctgttctctcgggaaggaacaggatgaagcctagttgtgctcactgtagagggagaacagggtggaacttttctgattactccattttccaggtctcagagccagagaccttcatgctcccacagctgaaccagtggatgatgacaactcttaagacttgaacactgtgtctgtgcagttagtgctcttagtggtagaattgttagaactgcccagagttctggagtttcagcttcataggtagcagcatagccatgtctgtgggtcccaacctgtcattccaaacttttctttttctagctagagcaacataaatcatttattaagtaattaggctatgttaggcattgtgacacattagacataactgtctcacttattcctctttataacctttctcaaagcttgtccttctttcttacccctctctgctgccatcactgtcactccaccctggtttatttttcttctaagcatttaccataactaggctacatgatatttcatattatttttactgatcattgctctctcaaactaagatgaaaacatcataacaatagagatgttttgttttgttaacttatattgcctatgcctcaataacataataggtgctcaataaatatttgttggtagatgaatgaacatatgagttaggtttcatggctcttttactgagaaataaaccaaacgtttaaaaaggagataaattacccatggtaacgtattcaggatgtggctgggatcagatctgagccaggatttaagcttgtgccagatgagttcaaagatctcatttaatacatcccttcaggtagtttacactctagcagggccagggattggctggtgtggggaagagaggcacccatctccctgcacaatttcaaaaggcaccaacattcaataatcaaaataaataacattgtaatgtacttaaaataaataacttgcaacgtgcttaaaataacttgtaatgtacttaaaaattcagaagttttaatgccaaaaaccctaggatgaacaaaactttaaaactttaaataaaggcaagatcagtcttattgatttttcccttttgcctcagacttcaatatggctcagaccagcactgatctcatccttgtttaaaacgataacaccctgaccccagccctgcactctaatcatagttatgcgttgaatcttttattctttgggcatttcctccctccaggcctttgggcaactgctcctagactttgggatatcggcctcttgaaatatgtgcacgtttgtgtgttttatctatattcttaaactatggtggactgatcatataccactgtgtgacatctctcactgttgcttcataaattctgacttcctcactttactaagcaatggccatttgcaggcgtggccttggcagcggtgctggctagccgctggttcggtttgttagtaccactgtctatactgcctgctgtttaactttcggatcattttgttgcattttctttattatttagtgatcatgagtggaaaacaaaaatgaaagagctgaatctagcaagaggaagcgtaagtctgccaatctaatctaataggaacaaaaatggaaatcattagccatgtcaaaacaatgctttctcagctcaatcagagcctcgctgcattttcctgttgactgtgtgtccacatgtgtaagaaaagaagaggattaaagaatgcataaaactgctgaaggtatattatcgaaaactgtgtcaaaagctgaagttaaattaggctttgatgcttttttccttcttttttttttaactctgctgggaccatctttgtaacattattaaaattattaatgtagaatatactctttaccaggccctcttctcagcactgctcatgaattaacttatgtaatcccataagaaccctatggggtgtgaaccttgtctgttttatatgtgctgcctattatagatgaaaaagcaggcacagagaggttaagtaacttgcccaaggtcacacagctagtgagcatcagagcacggacttaacccagttagtctgacttcagaattccatcttttgaaccaggaacaccaaacctgttacacaacatgtacatcaactggacttcacatatttcacttttgcacgtttctgttttcaattgcatactcattacatacaaacatagtgtcttgcctatgactctctcccatttttgctcatcctaacctttgccttttctaaggctcagataaaagctacctcttccatgataaaggaaacacaacaaaatgattcgaacgttgcacaacaggcagtatagacggtggctcggacagactgaaccagttgccttccctgatactccaagataggacttctgtatcaatcttagcatgcccatatgcccatagcacttaatttctcaattttctcagcgtactttattgttctttcactctacgcacttataatctgtcttaatacattgtgtgtatttcatctttgcattgtgcaaaatagcaatggtaataactacttgctgaagtgggtacagaggaatggggcctgcccagtagaatggcctttcagctcctgggaggcctgaggtttctgtggattttctatgacctttttatactgcggatggaaattataaagtgctatatacacgtggaagaactgaagtgtactatctactggaaagtgaagcagcaagtgactaatgacaacgtcctttcatggagatgacccttctgggacaccgtcagcaaagttcatcattgacatggtggaaattgcaccaggttggttccgggaaattctgccttcaggttccaacgtgacctttccagctccaacgtgaggaaagcagcttcttcttgtgtaaaatatggataattactcctgctctgtgtacctcacgggctgttgtgacagcaaatgaaagatgatatgaaaggacttcataagctatgaagcaatgaggcagttggaaggtgaccagattttccctgggtggatttaatcatgcttaattcattttccatgcatccttcagagccctgcttgtgtggacattcagagttacccctagctcctgcctccactctttcccacctgtttctcctctgggaggccggcctttagggtcagcagtggctcccttactctcaggctgctagttgggtttggccaatgaggggccctggcaggagactggagtgaggaaggaataagaagccagggtatttattctattgtcctctccctactcagggtctcattggtctggctatgtccctcaactgaggtcactgctgccctcaaggcagccctctctacctagccctctcattcaaatagctaaaggcagtgacagccagtgctggacactgcattctccctgtggtttctctacaccctgcacacacgtttgcaaacagtccctctaccaaactcgcctcaagttctcctaataagtgctatcatttcctactgggaccctcatgattcatctcctcaaggttttactttctttatgaggccttcctagcaaacctggacccagcagacagctactccacctggcactgaactcaaagctctcaccgtttttaccagttttggcaaagtgaataccatggaacattcaatctaatggatagtagtgacataaaaattattttccaatacctttgggagacacaaagttaaacagactatatcactaccacccccttttattttcaatctgcaggacttctcagagcatttcatttgcttttgtgcatactatgcaccactaggagagaaacacgcacacacacacacacacacacatacacacacacatacacacacacacaattaaactgtaagaagcctattataaaatgtatcactaaagatgttaaaatgtgaaaaaatgttggtcttagaattgatggaatatgataacatgtagacattacaagctttcttacttgaggaacactttttggaaagaaaatctcacagaactagagctttagggacatattttggcaaactcttacaccttttactagctaacagcatacacagtgtctatatatttatttcatgattgcattaaagtagctatagatgattaatctcttgctggcaggtaatcgttactagtcccatctttagacatagagttaacacatcctatgggctctgtgagtacttggtggttgaggaggctctgtggcacagactggctagctctttaccaagcctggttctgtttcctcctgtacacaaaatgaactgcatctcccagctttccttaaacttaggtttggccatgggagttctggctaacagaatgtagtcagaaataatgtggaccaccttcaagcctggcccataaaactctcccctttttgttctcttctctcatatgctggcaggatgtcaacacccaggacaaacttggaaaccttgcattgaagatggcagccacttcttcagcctccatctctgaatacatgaacttccactacacccctcttcccattgccactgtttggacttagagtgagcaagaaataaatttctactgtacaaagtcactgagattgtagaattcatctgttactgtgtctggtgttgtacaaactaacacagcctcttgtgactagggagttaggaggtctaagggggtggcctatggctgggcactgcagacagtggttttcgtggaggttatatacagccttggcctcttcaaactcagaacatctatctgcacccagtcttctctctgaagtctcccacatgtcctagctagtctggatattctcttgcccattcttcctgctcctgtgcacataactgtatgcaagcatttgttaaattgctttcatttctctgcatacatgttgatcttcctcctctgaccatgagtttcatggggtcagagaccttaatgtattattgtccctactcttaatgttttatgtggggcttggcattgggtagatactaaaaaaaaaatttactgaatgaacgaattcctaggacttattatagccaaaataaggcatcccaaacttttactttcccacatatttagactacctcccagtaaattccaccattgaaacaaatataaaaactaactcaagacactccaagaggaatcaaagcttcaagaacaacaaacatggaaaacaaaacaatttttatgctcaaactttccagtagggtgctgtcatagctaaatgcattttgttcatggaataaatctttcaaagatttactggtaaacatttatgttgagttgcttcatcttttttgtctttttctcattaataatatgtgaataataaaaatacctcattgatatgaagagttatgttaaaatagtgcatggcacatagccagggctcactaaatgttagctattttcattacatcacaggtgaagagtttcattccgtgattttattaagatgtctggttgttacttaagtcagtaaaccaccccccaaggtcagttccagctcatagcctgtgtttgtatggccctgcaagctgagaatggttgtcatatttttaagggataaaacaaaaaaacaaaggagagcaaaaaaagagcatgcctaaaatatgtactgtttggttgtttacagaaaaacgtttgccaatccttgcctaagggtaacagctcaaagactgcccccatggatgtgtctggaatcctctaagcagcccattgcagcttccctgcagtttcctcctttaatttttaaaatgtttgaaatctttaccaagtccgtagctttggtggctgtaaagattcattatacgtatggattgtccaagctgttacagaaactgaacagtgaggtgctgaggctgtgttccatgggggttcaaaagattacccctgtgacatcttgcaaagacagtgccatgcaaatgaaggcagccatgaggagctacgttgaaaagcttcatgctaatacttaggaaaaggagtcatgagggacgtatgcaattgacaatcagtacagccctctaagcagaaagaccacaaagggaaagagaagggaaagtagcatttacttaggtacctagtatatgccaggcatgtgctagatgccttctttagcatagcagcattttaattctcatacagtccagtgaggtgcttataattatcaccccagtttttcaaacaaggaaactggtttgagcaagttgtttgctcaatcaaggactcattcaaacaggattggagtccaggctaggctgatttataagcccttgttctttcctagaacataaggtgtttcaaactttgttatgaagtttagaagtagcccaacccacagaaagaaaggggtcaatatagacataaatagctcaaaaggccgggcgcggtggctcacgcctgtaatcctagcactatgggagactgaggtaggcagatcacgaggttaagagatcgagaccattctggccaatatggtgaaaccccatctctactaaaaatacaaaaattagccgggtgtgttggcgcatgcctgtcatcccagctacttgggaggctgatgcaggagaatcgcttgaacccgggaggcagaggttgcagtgagctgagattgcgccactgtactccaggctggcaacagagcaagactccatctcaaaaaaaaaaaaaaaaaaaaagaaaaagaaaaaaaagaaaaaagtcaagagagtatttacacataggtgactgagcatgaagagtgcactgggatcccagaaaagtctctgaatgtaggaatggataagattcctgcacagtagaccagggatgcctttttgttctctctctcaatctctttttctctctctctcagatgtacctgatttagaaaaagtattggacttaaaaaaaaaacaaacaatttctgagatccattccagccttacaattctatgcttccatgttttgtagtttctattgtttttattcatgaagagtttatgatcagttgatgccagaaagttgcaactcttgaatgactttaggaattcacctcattaaatggctctgtcacaaccctgagcttgcagggtcagggcccaagtgttccagggatagaaagctggcatttctgcttcagcaaagaggccaacatgcagcctctctgcttacttaacacctgacagaggggagagagagacacgaaacagaatacttgactgacactggcttaaggaatgatgatgtgtttgtgtcatctagtagatatttgccatttgtggctgctccatatcttccccatattttagttaaatctcatattacaagtcctccctgctcaaaaacaggagactagaaaactggtattttcagactccttcacagctagaccacaggcctgaacttgggttctatttttgccattgaaagtaatggcaaaaactgcagttacttttgcaccaacctatatcaatcgaatatacccatgtaagacttggattcatgagtgagcaatgtgagggggtggccatgtgtgggcactcactattctgagattcatcacggaagaggctgctacttcttccaaggagccaagcagagcttccagcattccagcacgtgcagaactggagctgagagcaatagctctgatggtaatgcttgcattgaaacagttcccatggcatggttggacattgttcttgtctctgtagttttaaagcttggctctctctggccctcatggagagtctgcaagtcccctaacatccttttaaattattgttttttaaaatttgaactagccacagtggaagctgtttgcagttcagattcctgactacagtggatgctgttgtttgcaattcagattcttgtcatgtgacaagaagtatggggcaggaataggtgatttcagggttgctgtggtggctcaaagtatcagtaaggattcagcctctatcttcccatgttttgtgagtttactttttatcttaaagttggttgtctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagaccaaccatgctttattacagggggcaaagacattcagattctactattaagaaagaagggagggaaggggttgctagataggcaactgatgcctaccaaaatcccactccaagcttgctccctcgttgacaagatctggcaatgggactccgctcctagaagagggagatttcctagaagattcccattcctgttttccccaggccaacttctaggtgcttcagggccttcagttgaacccattgtcagagagacctgggtttgaatctggctcttccacacccccagtgccacctgggcaagggtttcctcacttctctttcttcatctgtaatgtggggatagcaatagccctgcctcatggattgttgtgaagactgaatgctatagtaacactcaattcctgaacatgataagcaataactattttagaaggaggaggaggaggactagtgtggagtattctgatacatagtccttctagggagggtgactgacaacacatgtatataacccggtaattttagaatagaggtagttgataccatgtgtaaggtgagggtttcctcagacatgtgcttacaggtgtgttgcaaaacaatgttatgtgcatcagcttatttaatctcacataacacctttatacaggtgatgactcaaaggcttaaagatgctcatgatggatctgaaggaagaatctggtaagtgttgggcagaatcactcatccagttatacctgggctctttgcattcaacctcagtacctggaaactgaacaggaatgtcagtagcagattgcctgatgaccatcgaggatttatctggagaaaaaccaggagctttaaggtgattttctttaagtatcagcagcactggcttgtgaagcagcaatttcacatatatgtttagtctccagagattgaagataaggatcacattactggagataaattttgaacaacacaagaaaggacatggggtataagctacgcaacagtgaaatgagtggccttggggagaagtgagtttcctatcactggaggtaatcaagcagcacatcacctatagaggtgatccatgcttcaaatggaggcagggaagtatgggtggaggcttctgaggttcttttcagttctaagatccaaaattctatgagagctacaggcaggtcagcaccagccacacaggagtttctggaatggatggagaggcccttccagctgagaggggtgctgaatttaaagaggccctctggaaccaaacacaggtgtagattcctctgctcttcccttagtgcctctgctgggagaatgacgatgaagtcctccaggtatccaggcttctcccttgagcattagtgagagtagcttgttctgaaaggggagccggctggccattctcactgatggatctcaggaatgtcaccaccctggaggccaggataaaccaatgcatcctgtcctcttgtcaacattctttccctccaacatgacacagattaagagcttattttccaacagcctttgatgcatttttaaacatttaccctcaggattattcctcttgttctcccaacttctagccagctgattaaaattctagctcaattgaaatactctttcaaagtgggccattcagaattaagcaaaaagcactgaacttactagaggtctagcacttttgattaatctttaattaatacttcactttaattttcaatgctacctttaaaacacagagctgtgttcaaaccacaaactcattatcttatcattttgaaaggcaggactgtctgtcagagtataagaaaagggtactgtgtagtagtcttttcctggaagtcagttttgtaaaattttcattgatagacagtagttctgaaatatgtatatatatattagaaagcaaccatcttccaaaagatctaaagaatcagctgggagaaaattatggtaacacagggtaaaataatattgtgctgtgttgacataaattcatctttgttatttatcctgatgattttatctttttattggtgtatcacattgctgaaaatatggtttataatttaatttccactgccaagtacggagaagccactggaggcactgtaatgaggaaagaatagtcatggtacgaccatggaaaaggatgcgaagatgatttatgtaactttcttttcctatttacagtttattaagtcactgtctttttgcaatggccaagtgaaaattaaagcacttcagagaagaacttggggttcagcatcattaggggaagaggaatggatgccttgatgaacttgactatagaaatctatagagcacaacttaatcagccttcaaattgatcttggatgctcaaaagcaggtttaagactgaacaaatctttaatgcatatcctttccctttgaaaagcaacatatgatgcatgcatgagaatgatttagagatttttcccagacttcaattcataaagtaactgcatgtagcactttttgggatttcatgggaaaacaggaaaagaatggacactcttcatggacctgcctccttcctcagattctctgttcatgcccctgaaagacatcatctgtacaatggcaattacttagaagaaagggaagtcgcttgttgtccaaatgatcataataaaatcgagccactaatgttccactttctctttaactgcaggttcagagatgccagcagactccatgctcctgggctggcaaggagctgtgaggatcatgtagcacatgatctcccttccccatgaggagcagaagcttccacatgaggcaggtgacaaagtaataaggctttagtgtcacacaaatgtgactttgaacccatacttctccacttactgtgagtccttgagcacgttgttgaaattagttgagctccagattcctcaactgctaaaaggtgccaattaaacttactttatatggttgtcgagggaattaaagatactcattagtggggactagaggtaatggcaaccatcctagtgtcatgcaaaagcagactttattgggcaaatttatgggcagaggatcagtatgacaattctattcggtcctctgacagacaacggttcccaggagctgagttggccagatatagtgtgaggttgtgctctgggaatgggaccaacccttccctgctactctagctgtatataggaagaatatgagagaattctcaaaaaagcagcaaaagcaatctgaccttgtgccccggctgctcaatggtgttgtagataaacatcttgcaactggacatcagcttctcagggaggtatttattcctagactgatgtcagcccccatttgcaggtagtctaagcccctcccactggaagagttaagagttaaccacagagagcgatacatgctgggtacacaaggtggggcagatgctttcagcagcaggcagcaaggttggcattttagtagaggctatgccttggagtatacggttgagaagagagaccactttcccttgacccatatattttgtgagtcaagatttactttgtggcacttcagcggtggaactgtggcctgctgacaacacagctgtacttcttaaacatcccagctatctatggcttgccactgccattcagcaatcaggctttcctcctctgctacatggtgagttcagtataggcactgaaagcaaactagcagaaggcaaaatgaaattaggtttctaagaaaggcgttgttatctttcgattcaacaaaataaacattcacattgtacctccttggtgccaagaaatggagcaatgggagggggtttaataccagcaacaataattcctaacagttattgagtttgtctgcctccaggcagtgctctaagtactttatgtgttttataaaaaaataacatataacacctgcctttgatttaagtgggaagtcagctacttaaccaacctaataggcagtgctagtgctcagtgccataagagtgtaatagacaaaatgctactgcagcagagaagggttgcaaggaaggtcagagaagatgacatttgagctagaagggtaagaattagccacatagaagaggaatggaaggaagaacatgaataaaggcatgagatggaataaagccatgataatggtgttgatgatgatggtgattaagacccaagggcaaggagaggaaagagaaggaggaacagaaaaaaaaattaaataggatgtaacagatttatactctcagccatcatcaatatacctgtcagtgcaggtttatgtttccatacacacttttcattcatggactgggaagggactgagaagcaaacacaaataggactacaacagtctttgttgacttggccaaaaagcaaggcatcctgtctataggctaaaggttggttctccatttctcactgccattttaggtaaacacactcttaagaaaaactgtcattactcctcttgtgatctttcttccaaagaccccatgaatcctttgtaaatttggtgaggtgctctatgtaaaagcactttgagaaaggtagcaggacccaacgtggaggcaaaggcagtctggtaaagaagtcaggtttctcctttgcagtgagctcacaggatggaggcagccatggccaagctgtctaagggcagaggtaccacagcacaggcacggggcacttgggtaacccaggtctttcccccactcgcctgtggggagcccccacccttccccaccaggtagtaaaggctctgagagaagaaaaagacatgggttcatgcattcgcaaatgcttaacatttgtgaagtgccgaggccaagtgatttggacacctttgttaaggatctctcagtgtatgaggaaaagagacttgtaaaaaaataaccgcatataacatgttgaatgttataaaactgtgatggcacaaaggagggaggcaattgatggggaggggtttgatagggagggtgtgggtacagtaaatactccccaaagaggaatatacttgagtataagagagagaaaggagcttgttatgcgttttaattcttagtgtatatacttacctctttccattggaaggttttacttggcagggcataaggagtaatgaaggagggaaagggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttgggaaggtcagtgaaaagattgaggttagtgctatgtaagctccaagccttcaggaagatcctccaaggaagagatcctgaaggcaaaactgagttagcgggcctttgcacagctttcctttgcaagtccggtgtccagaaaatatgaacctcctcttttagcattatcctggtacctgttataaaagtaggaccttcttctaccaattacagtggggatgacgtgagggctgacatttctgaaggtctaccttttggcaaattagatggatggattaagtacataaaatttcatgtgattctcatgaccacattacgatattgggtatgaaaggctagacccatttcactgatgtctggaaattatggcttagagttacgaaataattatctgaaatgacattggtggtacaagtcaggattggaaaccaggcctcctttattccaaagcatttgtctttcccactatgcaatgtttccctgaaagcattagctggaaccactgcttcatcagagagtgccttttgtttgtgcatgatcaaatgtgaaaatgtaaaatattttatatatgccaagtatacctatatgagggattattatagttatttgtcattatttcagtgctactgaaagctttccattatttttaacttttaaattttatttttgagtcaggtccatgggaggctagatatttggagtttcaaatcagttaattacctaataaaaatgcaatataacatctgctcttcaagttaacatttctcctggtcaagggcaaatttggatgatgaaagcatttgtacattctcagactctgaaatccttacagtgatatttatcaccactgatttaaaaattggagggcaagtgtcttgaagccttttatctttccaacgtgtaattaattaccttgtttaaaactcttatgaagtaggtggtgcaggtattatgatcctcatcttacattcttccactaattcattcattttacaaatatacattaacagatttaaaaaatctaagccccagggagatagctgatttacctctaagtcaacagaagaagcaaatgacagactgaaatcaagattcctggctctgcgttctgaatttagggcatttctactaaaccatcttgcctgagtctcagcattaacctatgtcttttgtatatctatccttgatatcttaatgttctggcatatttcatatttctattgtagaaaagatcctgatggaaccagtagcttctaaatcaacacacatttgcctccaaccccccacctccatgaaaatgtggttcttaggactgctgtagcttcagcaatcctgagaaataaatgtatgaagtggcttgtgcactaactcaactacaggggatgggactgctttaattgccatgaggcgctgaatgcagttaacactcagaggaaaagagccttgtttcttggtttctttgaagactgacaattattttatggaacgacttcatgcattatcaaaacttccatagaaattcaatgagacactgcatagtaaagcaagagcccttcccctttacatagcaaatatctctatatacataccctgtacttctcaaacacaaagaagatcgttggaaaacacacagttatgctcaagggagcctgcagattagttctccagcacctcccatgaccctgctcctgcccttctcatctccacttctcctatcaaagattgaatcactcctactcatctaccatcattgtgccctttatagactctatgaataataaagctattttgttttcattttttattttctttcctacaaaatcgtgtgcttaccaccaaagtcagagattgattttgttttattttcatttgtagtcttgatgtctaacacagtacctagcacaaggcaggcactacacaaaatgtttgctggaagagacacaaatgcataaaatcatggtttccatccttagtcaattgcatgttcattgttaagcaaaagaagcaacaggctttgaacatatccagtgcttccctaccatgtgcagaatgttgtgattaagaaggcactaccttggccgggcacggtggctcatgcctgtaatcccagcactttgggagtccaaggtgggcggatcacgaggtcaggagatcgagaccttcctggctaacacggtgaaaccccgtctctacttaaaatacaaaaaaattagccgggcgtggtggcatgagcctgtagtcccagctgctggggaggctgaggcaggagaatggcatgaacctgggaggcggagcttgcagtgagcccagatcgcaccactgcactccagcctgggtgacagagcaacagagcaagactccttctcaaaaaaaaaaaaaaaaaaaaaaaaaaaaaggaactactttgtagaagaggcagttaaaaacagaaatgaagtaaaaaattcattgattgattcctcagatattaggtaagtactcattctgctccaggtatgaactgataactagacatataaagtaatgacaggggaccctggaggggcttatagcttggtagagagattggcctataatcgactaactaaaataaaccaaaatcctaaatggaaagaagactgaaatataaaattagaaaactttggaagagatgcaaatatagctctggcagaggaatccacatgaaaatcaattccaggaatcagcaacacactgctagtcaatgagcaatgggtctctaacatttagataaagtgttactcggtgtcagacattgttgcaagtttcttccttctattgtatcatttattccttacacttacgctagaaagtaaatactcaactccttttacagataaaaactcgggctcatgtgcataaagtaaatagagtatagtgtttaagtatacctgttttggagtctagcataactagatttgaatattgggtccataacttaactgtgtgaccttgaactaatcatgttacgcctcaggattttcacctgggaaagtggataatgatagtgcccacctcactggtgaggcaggtgaagtatttaatacggaccccactaagtgctatttctttagtttgagagcacactgctagcaaggatcaagatagggtttcacactcaggctttaccacagagctcatgctgtttttactgagtttgttgcctttctgggcaaactggataattgacatgcattcattagatatctgatgtggacaaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctggagagtaggtcttagcttgaggatgggaaggatgatgatttcagttttgaatatattgagtctgagattcccatggatcatacaagtacagaggaaagtacaaatggagaagctatcatctctaggaaactgactatgagcggaaggccaagaagttttgagtatgaaaatacgatatcaaaaccacagtgaaaaaaagtgtggctgtggctacagatatcttaaacaaaacagaccagcattgaaaccaaagcagtaacagaggcagacttcagggagaacaaactcacagtttatcatttaagaaacagaaagcaaaccagagctgagtccctttcatgagacccatgtgcttgctcagaagcagagctgaagtaatattctggaaggctaagtgatgggagtagggagagatggtaacggccttcagttttatcaaccaggtaatcaggatcctgctttcctggagagaaccagtttcttatatgccaagtcccttttgtttacccataagaaagactagctcttttggttccttccattccctttcctacagcagtatgtccagacctcaccctcccacaccacccttaagccttcattcatagttgccatcttcagtccgcatgtcattcacagttgccatcttatgtgactgtgtgtagatacatactgatagttaattttcatagtcccctttcctggtttcatggcctccacacacagctatgacactagtattgtctctaactctggcagcatcttccccagtaaaccagtgtgcaaaagagtgcatcttctttgctagtgacattttactgactggtgctcatggcagtgtttctggtgcacatctggctcctccacaggggaatttccaaggtaagtgtgggaagacaaacctgcaaataaactccaataaataggataaatagcaggatgtatgtacaaggtttcaagagaaattggactagagttcatttcacttcaaagaaaccttggttagtcttcaaaatcaccaagtaaacatgggcagaaactccctccaagcaaagcacacagtatgggttgatttattattttggctactttttcaaaccgctttggcaaaaagagcagaaaacctggacttaaccagcttaaatttatgatttattgtctcccagagcaaggtgtccacaggtcaggaaagctccagggagggtatattaggaccctgactccacttcactgtgaccctgtcttcctttccaagttttgcttcatcagcagttccatgcatcatatccaggcatgccaatgacaagaggaagagaaggggctgtcttttccttctgcctctttttaagaccaaggaactatttcccataaatgctctgacactttctcatttcactggtctgaacaaggtctgtgtgcatagctctaaacccagtcacttataagcagtatgggattcctgtgatagtctgagactatttggaatttgtcccccaagagggatagggtcatgttttctgagagggcctacctgaacaaaatcagtacttcatcaatgaagaagagaaggtcagattttaagtatatagccaacagggtcagctacagttactatctacatataacacttattttttttaaagagaaaaaacaaaaacaatcacaaaggatgctgttagaataggatcaggctcaagaagatacactgattctgggacaaggaactctgcttatggatggcgtgacacaattatagagaaaatctgaagatctaaagaactggctgcctgtgagcaacagctgcagaaatgtaaaaatatatcctgtttatccattaaacactaccgagattgagttgagcactgcaccatgtcagataactctgtgttcactatcagaatgtgtgcagttttagagtgagcagtcattatatgttacatcatgcgcagttttgaaaagtcacggtcactaggtttacttgttggaaacatatccttgtaaaagataaggcatcgttggcatgaaactctctttcacatatacacttacacagagaaatatgtataactgatcatttatttttctttcatattaaaccttttttttttgcttttagtaagagtcatatcaatgaaaatggcaacatttagtctgagaaagttaacagtatatggtatggaacaacacaacctgaccccatatcttcagctggctttcagttttcataaatgaacttctgagagacaactaaaaattcatttctggtgcagaaaaatgtgcagaatgggaactatgcagaatgggttaattccagaagttgaacaaggggaatgcacatatgcaggcttattaagttatgtgcaaatgataagtacagtgaccatctccattgctaaaaattcattgtgaatgtgttgaagttgggattgatggagatactgaagtgatagccaaaattcacccagaaacaagctaaagtgaaggttaaagaaaaacagctgcagaagaaacaaactgtggagacatctccagcagtggaagcaatctgtttttgaagacagcgaggaactccaggcatctagcacattctgaatgggtaaagtcggactggagtgggttgctgtgggaaggagccattctctaaagaaaggtagacagcttctcacggctgggcctctaatgttaggctcagaaaacttactaagttgacaactctctaattacacagcctttgaataaaccgtgacatttataagaaaagacatcctgtcatttatttttgttacactggtttttgccttgcacactggtttaagacttcatgggacttttgaagaacaaattttagacctctgctacagggcaggttaaaatggaatcatccagttgctggttgattttttttcccccacgtgaagtctcccttggaatcaaggtaccagatcttctcttggttatctgaaatgatgtgtgctcatcttcagtgaagaagttcatgactcaaatagatcctagtaatagtgtctaattatatatgccaacctttccctacagcaatatacttcccttcaaagtaattctaatattattactttttttggtattgcattaaagaagatagaaagattttaatgctatctttaggaggatagaagcgtagctgtagaaagaagagaaaaattcagggagttcttattacctggttttcatgattagagtctccacagttgcaaagttttacagaaaagtaaattcacaatagcatgaaaatagtcatcactgaattgaccccttaaaaaatcagtccccattcaaaatcagtctcgacttaccactggaatcttagtcaacatcataactgatctctcaccaatttttataaaatagtcttataaaaatgctctgtaaattgattataaggtaaatttttaaatttcccccagaaatgggagattcatgaagtttaaaaaagtgatgttgaagaactgctggaatcacacgcagaattattgatatgatgatgtgacagaaacattactagatcttatttgaagaagaggaaatttttaaggataatgatagtttaggcttccagaagagaatgccatgaatcccaatagaattagggaatattgataaaatacttgaaatttgtaaaataaccctttttgtgatgttgagaaagtcaaaattaagtaaagaatatgttgtgaaatcatgtaatttttattagaaaaattgtaacaaaagttgaaacatgacaatttatccttcaagaattagtgaatagttatatttattacctgaaatatttttcaaatttaagtaaaatatactaatttttaaataaattttcaatgtaaaatccaagtcaaaatattttcactcatctttaaatgaattttggttttcattttaagataactcacttaaaatagcgttttctaggtatccattgtcattaaataacatggaatgtctgtaaatattcttatctcttttcactgagccatacaacctcacatgagactagaaagtcccagcataacaggtttctggaatggaagtgtaacactgtgcttgaggtagtttcaaaatatgtccacaaaagaggcagagcctaattcccctcttcttgagtgtggcctggacttacgacttagtgctaattaataaaacaaaacagaaatgatggtgggtagagtggattgcatagaaacacccacacccaccgcacaaatttgatgtccatcagaacctcagaatgtgaccttattaagaaatagggtctttgcagatataattagttaagatgaggtcattatggctggccctaatccaatgactggtgctctcagacaaagagatacaccgacagaagacagccatgtgaagatggaggcagatattggaatgatgcatttacaagccaaggaatgccaaggattgatggtggccaccaggaatgaggaagatgcaaggaaggattcctcccctagaaccttcagagggagcacagctctgctgacatcttgattttgaatgtttcacctccagatgtgacagggaatacttttttattgttttaagccaccagtttgtgtcactttgctatggcagccctagaacatcagcacaggagatcacttcaaagactgtgatataaaggcactgcggctttctctgtgctcactctctcttggatctctcactccagtggaagttggctgtcaagtcgtgaagatattctagcagcctgcagagaggccccatggtgaggaactgagccttctgccatggccatgtgagtgagccatcttgaaagtagaccttacttttgtggaaccttgagccagaaccccagtgaagctgcttccaaattcctgatccacagaaactgtgtgaaactaaatattgttttaaaccactgagcattgacgtaatttttatgcatcaataaacaactagtacagtcccctttgttccctcagatccaatttccccaactcaaaagtatactcaaaatgcactcagcattgaacagatccttcttctcctaaggctctgataactttttataactttatttccactccttgtccacctcttttcctgacaggataaaaagtgggcttctttcttgcacagaacgctctgtcatataggcccatcatctctgatatgtgaagattctaaataaagggcgactggcttctgtgaatgagttttattagttttattaccttagatatttcaaacgtgatctgaagtttctcatattcccttgagaaatgctcatggacatgaatgctaacattggcattctacccagtaagctttagaggacattcaagggaattcacatatctatgtgaacagctggtctctggtctccctgatccctcgagagcccagtgagggcagcttgctgctttaacaatttttccagtgaggaagggagaggatacctcaccatggagcagagaaaatggaagcacttacagacataccacaggtctgcaaaggaggcattggccttttgcctgattttacccaaacttatcaagtgcctgccatgcactgggcacaataagttaaaggcccatcattatcaatcaggaaccaccttccaggtgacaactgcatccatccaatgttgaagaaggaaaggtcagagcaggagaggagaagcaaatccatttatacagcagcctcagaactgcaggatcacaccccttgggtgaatagacaagctctgatgactgtctgagtgtggaaaccctgagctggggctgcctatggtcagaaatgccagccaatcttatgtgccccttgttgcacaatgatctaagtgctttacaggtattagccctggaaatcctcataacaatcttaacaggtagcaactgttattatcctcatttcacaagtgaagacactgaggcatagtaagaggcaaagctgagtttaaagctgggcagtctggcttcaggccatgcccctccatattaatctctccatagtcttttgaatgccagcaaaaaggatgttttactctttactacatctgatttggaattttgataaaaatgacatgaggcagaatttcaagccttttaagcaaatcatgcaagtctaatgctgtcgcgcttgctctaccgctgtgggctgatttgtgtctgtgctgggtagatatgttttagaaaagtacatgatgggaggcaggctcagctgttttgcgatcatgccctaaaatggttaggaagccagtggctgacagggatcaatgtagcactgtgaacaagtctaaataaatgttaatgtaatattttgggatgaaattaattaggtgtgctgatagttgcctgatgaggtaggcagatcagtatgatgtggaataatatggacagtttagtgttatataataaacccaaaaccatcctatgacgccctggatgacagctagggaatctctggagctcaacatagattttctttaaatagaggctggtaactaaaagagattctgagtctcacatcagctgcactgcatcagccctctttccttaatctgtggttccaaataattttgtaagtagataaaattctgaacccacccaataataatataaccagacaactaatactgcaatcttccctcttgcagggaaatcgctccagaaggcaaatgaagtagtctcctttttaagcatcctctgcttttctgttaaagtttgtctcattgcaggaatcacagcagcttttgacagcctgggggtggtgaatggacttctggatatttggagaatgccaaaatcctgttatgtctgttattgcagtgtacccttgagtacagtctccccaacttttttcaatatcatggtcacttgggatatgataataacgcatatcatctaattccaaaatgcacttctttgcatgataaaatctcttaagttgggatatatcttacaattgtgagcaccttacaattgctgtcatcttggcagcaggaacatggtacataaaatcatcctgcttcttataatggcaggaatcagtgggatatggtatttgtgcagcatgctggggtaaatgcattaggcttcatctggttggaggcagccttccatgggtctctgtaaccaaagcttctagacagcaccccttggggactgagaagctcaatctctcaggtgcctctgtgattcatctgtaacaactcaggagtgtgtcctgagacttgtctcctcaagtctgagccaccctatctgtgaaacagagatcagaacagcactttccagacgagaccttttggggaccttctgcaactttatgtgcacaaagtacctttcatataatctgacatcaaggaatttcagttactgctattggctttacagagccagggctaggttaaggcaattgaggcattcaccttgggcacaaaatttaagaggtgccaaaatctcagtgattgagataagtaatattttcatgcaatatttttaaaagccaaaatcaatgcaagaaaggatgaaaaaataaaaattttaaacagagacaggatccagctcttcatttggttgatgcatctcattgacttatcctggtcttagtccattcagattctgtcttgaatacttcaaatattgcattaaaatgctatttatcttgattactaagtttttttggtgtccccttaaattttgcacctgaggcttgtgcctcactcctctcacactcatgactctggtgatatttctgatgcatctgatgattgtttctaattgtgcctaaattggtctgatattaactatctgttgactcatatactcattcagcaagcctccaatctgttccaggtgctgtggcaggcaatggagatacacagcactggcctgtggagaatgcacataagcaaacaaacatgtgccatatattctttagggctgtcgtgaatgcatctattcattgattcactccaaaatgttcagcaagcacctcctctgagtgtgcccaatatgagcctgggacaactggagtcacaggaagaaaatagtcactatgtgagtcagtgtttccttacaaaacatttatagtggccggaggcagtcgtgagaaatccttttgaaactaaaaaattgctgtgggcagggcatggtggctcatgcctgcaatcccagtactttgggagggcaaggcaggagaatcacttgagtccaggagttcttgaccagccagggcaaaatcgcgagaccctgtttctaaaataataatacaaatagctagacatggtggtgcatgcctgtggtctcagctactcaggacactgaagcagggggacttcttgagcccaggaggccgaggatgcagtgagctgtgtttgtaccactgcattccagcctgggtgacagaatgagactgactgactgtctatctctgtctctctttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatataaaactaagttttttggagtccttttaaatatatgtagttgtagctagctcacatgcatcacctaccacagtgcctagcacataagatacacttaataaaatgtttgttgaatgaccattcaaataaatggcttcctataagtaagatggagatgacaaggttacactatgcccacctagaacccctttgagtgccttggatgctggagggcttggtgcaacggaaagatctgtgatcagtagatctgaacttgaaacctggcttcaccattcattagctgtgacgaccttggtcaatgtatttaatctttctgcaactatttcctttaataaggtcaatactaccaaatgtgcaggtctttagtgagattatagatctgcaaagtgcttcataaagagtctgcctcatagaagaaacttggtggatgtgcatttctttcttttctattttgtttcagaacttgatggaaggaagtacaggtcagaaaggctgagttaaccccaggcaaaaaccactcgggaaatgggcaatgagatatcacagccgctgtcatgccgagggctgtgaccacaccaagaatgagaccactctctttctttgcatgaataccccataagcaagttgaatatgggatgtgaataattcaagtccatttccacaagacagtcacagaaggattggcttcttcaggaaagatgccaaactggggtctttagaactagcttcccgaagacatgcttcaaggacagggaaatacacatgctgtaagcagggaagtcctgaatgctatggcagagatgcaaattggggctgtgtcatgaaaacaaaagttaaaccataaaatgtcactttacatgcagtttaagagagatctatgagaaataaactttagcaaactgctcacatatatcagtgtattacaggtgcctggaaaagcatttctatgaaaatatgcagcatggcatatgtataaatctgtcctgagttttatggtttcatatacagaatcataatgtatataaagtagaggaacacggagatccagtttactgctttaacccatgctagtcaaatggtcttggaataatccaccgaacttacaaagcagcaaacaagtacactcgccacctagaggaaagccagcagcaaaggcaggtctgtctgcaagcattttgtagagtggcaagtgggtggagaacagaatgagatttcttgaccacttgcaaggggtgaggtctctgtaataggtgaggtctctgctaagcacattacattcattctctcacttcagcctccccataactttatgaggcaggtactactgtctccatttcacggatgggaggaccgacaggcaagcgtttgagttacatgtggaagggcacataggcagcagatattgcactgaaatagaagcctcatgaaagcaagggccttgcacaccactgtatcctcagctcttagaacagcgcccaacacttagtaagttcttggtgcatgtgttgagcaagtgagtgaagttggcaaacctggattcagctgactttttgtctggtttcttcccatagaatctttgcagtgatgacaggaatgaagcagcttatttgtgcagaagagtgaattcatgggagtgcagggacagctgcagcctctgagagggcaggttatggagatcctttgggaattcacagtttaaagggcaagctgccccttcttcccagtgcctgccctgaccatttctgcagaccgcgctgccatactaaattatccctgtgctcacatagtagcttctgaggagcaaagctgcctagcatggagtctagaaagaccaagatgcatgggggtggcagacccagttccaagcctcagcactgtcacttattagctatgtgactttggaggtatcacctaaccctatgaaatgagtacattaatgcccatcttaatatcttctaggctggacaagcttcataggctagatagtactcaactccacagcctgtaacctacgatgcaaacggtggcccctgaagttgttcaacacagcggccctgctcctggatgaggacatgggtacagaggagaaagaaggcacaaacagagccagccaaacctgcattcaaacctcagctctgccattctcaagctgtgccatcttgcctcagtttcctcacccataagtgggaataaaagaaatatgtacctcacgggttgttttgaggatgaaattaattaatacatgtaaagcatttggaaggcatgtagcaggtgaatgagaaatattttattgttattttaaatttatgatataattttactatttttaaaattctgtattgaagcaacttattttagggtcttttcctgaacagatttgaagcttctggaagtcaagggttgtatccacttatccacatatcaccctttgtctagtgatgggcaaatacatggtccttgataaatatttgttgaactaatctgaaccatctgttgtcagataaaatccctagtctctttggccatgtttcctcatgaattactttctcctgcttcaaacattgggaaatttgagccaaacacttaacttgttttagttaaaaggtttagatttcactgaacttcagattttgctaaactttccttccccacttttagttccatcttaaatcctcatattttgaaagaaattaggaaaagctctctatgtggctgttagccagaagtccacacataataaagacttctagttgaaagggcttaaaaaaaatctgctgctcttctcctttgggtcatacaattaagtagaagaaatacaaaggcaacaccttccacccaggacccagccagcatcatgcagcctttaaaccttccagggccagtgttagaatcagggcagaagcacccggtttgtcacttgcaacattcatttgtttgcaagacagtatcagggtggatggacactcagtcatgaccacagcccagttccgttcaaagagatttcagctgcaccgagtcagaggcgaggagattgggcttgtctgtgttctccacactataatgataagtggaggtgatcaattgccagagaaactgcagacaaaaaagcccccattaattttctgaaatatttaggaatttgggtaataattcttgagtagttaatatgtgtcacatatagtactattatagtactactaggcacttgcttatatgttaaatttagtcatcatggcagttaaggtaggcatgatgaaccttcagattacagactcagagaggtaaagtaattttcccaaagtcacacagctgaaatttaaatccaggtctgaatctaaatgtcctatgctgagttaaacacttgggctgtggaatcagaaggatctagatgtaaattctaggtctgcctcttaagagctgtattgtttggaggaacctattaaactttaccaatatcatttctaccacatggtaaaatgagaataagaactccactcacagtgttgttgtcaaggttaagtaacatttggcacctgagtctctcagcacaatgtttgccacaaagtaaacaattaatcatgttcagattacttattactactttttaaatttactactcctacatcatgctacttacataattcagatctctcccattctcttaattcttaagagaaaaatggctttagaaatgtttaatttagaaaccctaatttgtctaagctgttttatttaaatgaaaatgcattctatttagaaataggggggctttatcatatgtccttggaaaaactgaaaggagacaagcggatagctaaatagagcttgagtccactgagagacattaaactgaatgctaatatattattatatatttgctaataaattatatttgttgtttaataaaagagagaatatttttaaagtcccaatgatgatatttaactgcataataaaccccacagaaactgctaatcaggagtggggtgattaaatactgcagtgatctaatgctgaaagccttggcattgccacccggtgtccctgatcctcaggctgttctgcataaggctggacaagggctggtctgtggggcatggcctggagcttgtctgctgtccctgtgctggtcaggggccttgctccatgtgcagggagttctgggtaattagaatgtctgtcccagtgattcctttaagcagatatggcctgcccatattgggaatgccccaaaccccaacagaggcacttgcccatgatgttggacttagcccaggtcacctcttggtgcatttactccaatctgtgcttctttctgctcttggttcctcagttcttcagactcgttagctctttctgtccactgtaggatgccctggtgatatggcttggctctgtgtccccacccaaatctcatctcaaattgtaatctccacgtgtcgcgggagggaggtgaatggatcatgggggcggtttcccccatgctgttcttgtaatagtgagttctcatgagatctgatggttttataagtgtttgactgttcctccttcacatgcttgctcttctgctgccttgcgaagaaggtgtctgcttccccttctgccatgattgtaagtttcctaaggcctccccagccatgtggaactgtgagtcaattaaacctctttcctttataaattacccagtctcagggaagttttttatagcagtgtgaaaacgaatgaatacatctggccttggtgacctgttatacaggcatgctttatgactcagtctctgcacctgctctcagatacacttcagatgtttaccttctggtcctacacttggccacggatgagaggcaccttcatctcgccaagattctcagggaatgatcagccagttggcttgctctacggttttctttctccaccttcctcacgagattactctggccaatgagtggtccctggtgagaaactgaggccaagtcaataggttcacagggcaggggtggcagcagcttcacccctgctggacattgttaatgttcagtgaggtcaggcagtctttggtcatacaggagacctaggattaggtctaggcattgggaagcaatggcagagttgtggctgggaaatatttctccagggaagagtgaaatgcatgtccatgcaatttgtaagttaacagcaggcactcaatctcttgactctattactagtggcatgagtagttttcagggactagttttgtgggtagctcccctttagtctgggaacttggatgaagagatgagatggccgaggagtcacttcctaatgaaagcagcatctgaggaaggtgagttctgcacaagtcatcatgccaggactgtggagggtccctggaaggcagaggcatcaagtcttggttcccctttctctctcctagaagagggtatatggtacaaggcactctaaaggcttctggccacgtggcttatgacctaacagaaggaactggagcatattcaaagcttactgtggtgtccacaggggattaagcaaaccagggaataatgtgatcattcatctttccttagcatttggtgtgtgttgggtctgggtcccagtgctttatccagctcagctcgcttaaacctcgcaactaccttatgctctttttaccccaatttcacagaggagaaaatggaggcacagggagattgagtaactggctccaggtaactccagagtcagtgctctgatgctgcccctcttaccatccatttggttctggggaaggttgagtgcaaaacctgataggaagagaggtggaaagagcaccagttttggatttaaatcaccccgggtgtgcctatggctctgtgtctttctgctttgttacactggcaaaattactttactttggttttcttatctataaaatggaggataacgccagcttgaagagttatgaggaagaggtaaaatagttactgtctcccaccaagcccacagtgcctggtccacaatgagcatttgatatatgttggttcttattactatacagaaaagcactttgtaaaatgtgaactataatagacctttaaaactcacaatagcaagattgtaatatgcaccatccttttaagaaataaagttgagaattaaactatcacacaccattgactataagacccatctcaacttcaatgatgctaaatgcaaaatatagtatagtcgacctaggtgcaaaaaactcaaaaagcatttgagatccccttccaccctaactccagcaagaaaggaaagaaatgcaaagaaacaaagacagaaccagtttcttgaggagcacagtgcctgaaccataaagaaaatgaaaagctacacacagatgttcatccaggccagctttctgctggtaggtaatgcatgaaggcaattaggtgctggctcgtctcttcaacattcatggagctgcagagtttaataacgttgaaatctggtgctacctcaaagtaaaaagaggtaatgatgaaagttgcaattaattccttaaatgaattcttaaaatgtcaaaatttgaactacacaagtaatcagtgtacagaaagtggccacaaggtatagaggaggaaagagtgggggacttggagcctgaagacttttgtcatggtctttgctttcctccctaattgccaacaggatctgaactggctgattcacctttggactcaattaccttatctgtcaatggggggctgaaggagcaaacagtaaggctctttcagctctgagcaggcatgcacctgtgccccgcgcaaatgtgcaagccttaagctgaagagggtattaggaaagtgaactttctaatgtttctagcattcccgacctgtcccctggacaatcctgtctctttgctgccagtgctttctatttgcagaaggactgacatgcttgattaaaatgtctcaagcatatccaatcctaatgtattagatctttctttcctcccatgcaatagcagtggcagaaactctgcattgcaaactcatagtttgtttcccgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacaccaaacttctgcacaaaccagcgtttacttatttatttggtccacaacgaggaggaatacagagctgaatatgccacaattcccatttccagttgattctcacattctcatggggcagaaagacagcttcaagatccctttactacaagctgcttgtgcagagtcctaggatggaggtatgatgaaaggttatctggaggtctgaggaaccccaagttgaatcagggggcttatgaaaggctccaaagcgggggaggtcagatggggctcaacaggctgataaaatggttctacatgtagagaaagaaggaattggtattctaaatgactgacataacataaagtccatggttcaggataatagtccagagtgaacggtggctgaattatggattttacagatgtctgtgtgtacatgtgttacaggagacaaacagggaggttgatcttatcttatatgcagtgcagagcaattcatttgttttgaggaggaaagtgataccacaattacataaatcaaggatttaaaacattatcatcatccaaacaaatggaaaccattgttttttatttaccaaagcatatattccatgataatatttagtgccatttacaaagtatctaacatctccaggcattttacaattgtgatgtccttgccaaaaccctcctaaatatgtattattatcccgttttacagatgaggacactgaggttctgagaagtgacataatctgcatatcatggcagagcgaagactagagaaaaggctatccgattcaaaaggctgctttactcccacctgcagtatacgcctaccaccacatgctactgattttggcagccaagagcatgactctgtattttaacaggaaaagccagagatgaaaagtactgtcattagcatagctcctcaaggttactcttaggaatcctaagcaccataccatgcagcactatacaaaaatctggttcagataatgatgctggcccaatttatctgtcatgatacggctgagacacacacggcttcatgcatcaacttactatcgcaacaaactattagcaaaaaactattattgggtttggggaaagagcagcagtcctaatgttctattcccacagccattctcataggaaagggttggaaatagaacagagtctatctttacgatctgaatgacataagagacagtggatgacacaagcacaatattctgctttcataattttatgatttcctgtctagtctgcaggaacaagtaaaacaacaacctctctggttctgtgatagcatctgtccttagaaaacactcatttttagcacagtcagggttgaaattggatgagaaattcaggggtttctccttagcctcagttgttcaatcttcagaggcccactgtctgaaattcaggggaaaaggggctcagtcaacttcatattaactttttcttaatatttataactgtgacatgcaactataactatattattatgtaaattgagaaacggaaaggagagaaatgactcattatatatctctctgggaacttccatcaaaaatgtaaatcatgtaagtttcagaattctaggtgggcacctggaatcttccacttgtagttttctttggagaagattaaaaataaagaaaaccatatgttccactttagtgagcaagagtgaagggacatcggtattaaaagcagaagcaaaataggcagatgagagcttcattttatactgagaaggcatgggtgcaatttacctgcaggccattttcactgggacaacgaggaaaatgtgcccgtgcagagacaaggagtccccacagtctaccccttccaccaattttcagtgttttcctgaacagatttcaagcaacaaaacagtcagctgctgggtaatagctccggttacagctgaaaatgttagtcatttcattatacacactccaaaaggggtatataaaagttgtttacaagggcaaagccgtagttctgaaagctggctttaagagctccttctaccttgccatattttaattctttgaacgtgcaccaacaattacatttttataactgctagcacaggaagttattaaaacacttggctcctatgtgtcttggtccttgcctctgctggaacattgtaaattgttatggctagcacatttgtgcaaacctactgagagaaacatcatatggaaataatttcagtggctagtgaagggtagttaaggacaaccttaacatctaggccatatgatgcagtgattaagaggaaaggtgctagagtcagagggactaagcttgaatcctagatctgcctattaatccctatgggagcaggtcacttagcctatcaaagtctcggtgttcccatttgcaaaatgggaacaataagggtacctccctatataggatgtggtgggaattaaatgagatatacaaagcatctagtaagtgcccaatgttagttaattattaattaattgttagttaataattaacataagctagttaattataattagttaataattaacattaaatgttagttaattgttggggtgatatctttttctcttctacatcagggcagagttcttcaatctgtggcagaatgaaatttcatgaccaaatccatacaagaaagtgttgtaatcactttcttaagagtactgaaagtgaacaatgacaaaactctaccttgtgcctccttcaacaaggggtttcagcccacagcaagattgacactgctgcctggccatgtctgtaagtgagtgacagcaggtaaacaattgtcagcatcccaaactagtatgttaatgtctccccagtggccacgtttgttatcctgttccctcatattggaattacttggctcaggagatctgccaataatatacttttggctgggttttgaaatcaccttgggatacccagtcacacagtgaggctttgtggtacatggttctctgtgccacgtttcacacaggccactgaagggctgtcaatattggcatcaggagagctgagttcaagtcctggatctacctcctattgatgatgtgattttgggcacattatatgaactctgagcctctgtttcctcatataaaaaatgaagaatggggataatattatttatttcacagggtttttgtgaagactaaaagacgtgatgcaaaagggcattgtaaagtataaagagccacatagatgttattataacttttggtaaacaggatcatcattgttggatcagttgcttatattaagaattctgagggtttctgtggctgaagattgccatgatacacataagaataaatgttatatttcttatttaaaggtcagagtggtgagattggataaggataaggtacaatggtgagaggtgagtggctgtttgtacagggctgtgccaggctacagggatgcagaaaaagaagtgtgcaaagacagagcaagatttacttattcctgatttattagaactgaatttctttacatttttcttccttccttacaggcatatcccatttcatccttatgttctttccaaatctcattcctggaaaccctttctcccctagtctcttgagacactttggacttagcactcatgaagcattaatttttaaatggcatatgcttttacaggatccagtgctgaccccatgaaattagccctccctatttagaaccacccaattatgtagagactcaagcacaatgagatctgcaattctctttgcctcataagtcttaaggctttattttcagcattgtcttgttttctttctccaaaacatccaggaaactgaatggctggaagtctgactgcaaaacaatggttaggatagtggccaaatatgtgatgtttctgaatatggaggaggtgggcctgacattccatgctgcagatatgcaagaataactggaggaaagaaccaactggtggggcatagttggcccctgtccacattcacttttcctagacagtcttggaggatggatgctttttccttaagttaggttttctcctccccttaggcttttacctatataacagaaacagacttctaatgatatatttatatatgccagtaacatataatatatagagatgatatagctgtgtattaatagttgctctgctatgtgtctataataaacactacatagcagttattgatttatctctcccactaaaatacctttaggggtattcagaatagacgcccctccagcagccatcttgatacactaagatttggggaagcaaacaaaaatagactgagaatgggacaaagatattacactaagtatttgacttaatcctactccccacaacctgtgggctgtattgcgctgacctcctatgaagccaaggacagaaactgtactctctgaaatcttaacataaaataccttccatgccatttatgaagccactgtccctcagcttcaaatctaactttctgtactttgctttgaggtgctgggactaaggactagcaacctgcgtttctgctttgccagctgatccttgttaggttctgccagtagggggtgctaaaggagactgcgaggccagaggacacgggagagatctgatactcctagtagtgtcagcttagtgtttgcttcaagcaaagtgttgctggcctcgctttttcattctggcagcagcagttcctccctctaacagaaatctaattcagtttgcagtttctccaacgttgcagaaccagcctcattgtggagattttctaaatgcatgagttaaaatggcaaaagtggaaaaataaggatgagagagagagagaaaaaagatgtacatacagcaagtataggattagaaaggcattaggaaaagctttacctgtgaaaaacccctttccccctattatattttaaacctgctgagtttgataaaatgagaactaggtcactattgcagatgtgtgttttttttttttttaatgagatgatttgggtcaactttctatataccaactttatatatagttgtttcaaaggagactcagcatagcaaagagagagcatagtaaaaaattcatgggaaaaaagctgcaatcaatgtagaatgagtctttgaaaattagccaattaatctggctttgctttgtttccctcatgtctagggacttgatttacataaaataaatccagtgtgaacaatgaatacatacacagaaaataagagttgaataaaagattacttatgtatatgactagacacttcaaaggcttatagtgaaagatgaatcaccaaaggctatatctgaaaagaactccagacccatgattttcttaaaatgaactataatggattctgtaaggctagaaagggttcaagacagaactgtaagacttctcatatggtccactatatacaacagccacctgcttgctattgccattaatttctgccttaattctcttacagatagaaccagatacaacagccaccctcttgctaatgccattaatgtttgccttaattttctcacagataaagtcaagaccaattagtggaaaacacacagtggtaaatttcaactccttgaagaaagtttctaatgatctcatctgtatgatgaaggatcagctacctaggaaggtagttaatttgctccaactagtattagtgaagcttaagttggaggactgcttgaatctagaatcagacgggagagtcccttttgcactgagattctcaggattctttagcagccagtaacaagaatatgttacaacagaaattaacagctctattcatttagataagagaggatttgagacagaaccagcctttaactggagtcttttttttttttggcttcaaccttagcaccttctcccacctcaaggtgtgcattatactctagaggagacaggatgccttacagtaatcatatttttcagaggctaagttgctcttcccaaaggaaatacagtgccataatcatgtataagagttctgggttcagaaactatctttgcttggatcgccataacaaaataccatagactgagtggtttaaacaacagaaatttatttctgtacagttatggagtctggaactccaagattatagggtgccattgtggttgagttctggtgagggtgcttttcctctgttcacatggcctttttttttctctgtgtgtttgtgtgtatgtgtatggggcggggacgggggaagttggggagagaagagaacaaactatctgatgtctcttcttaaaagggcactaatcccatcatgagagtcctatcctcacaacctcatctaaccctaattatctaccaaaagccccatatccaaatatcaatactctagacattaaggcttcaatacatgaatgtggaggggaggcacaaatattcactctataacataaaccaaagtgtgaagcaaaggtgtggcaacttactagttggatggctttgggtaaattgtatacaccctctaaatctcatttacttcactggaaaatatgaaccacaataacttctcgatgaggttttggggtactgcataagtcaacaaacagtaagcatgtttcacataaaaaatagtccaagtaaatgtagccactactactgttgttgttatcatcatcgattccgataggacaaggatgaatctggaagttattccatacgctgctctttctgtctccattacctagcccctgccttgctttgctaattagtagttatgcttaaatccagctcaagttttactttgtctagaaggccacctttgattatccccatgagttagatggcacggaccttgctctttcatgacatactaggatgcatttgcatgcaaatagccttaccattgctgggtgaatgtgattttctttctttgattttgctagctagactctgagatacttgaagaaccacctggagttagtcccagcttcacagttaagggcatagttttccacaaactcctctcacttaagatgccagtcacaagtttggaggtctcttgggccactgtcacttttgatgagctggatacaaattcactggtccccacggacaccctcaggtttggtaattcaatagaactcctcccagaactcaggatcatgctatacttgtgattagaatacaaacagggaccaaccaaagtaagagatgcatagaaagaagtctgggaggattctaaatgtgaaactcccaccatcctcaaggatatcttaccctcttagcacatcaatatatgacaatacttataggactgccaaccgggaaagctcacctgagctttggtgtccagagtttttattgaggcttaattgtgtccactgattgactgaatcattggccatgattcactggccatcaataaccagtccctttcctttccccatgggttaatattaggcagctcaaagccccagccttctaatcacacagttggtctttctaatgcagccagctcccatcttgactcaccttattagcataatctatctgggagcccaccatgagtcacctcattagcaaaaactatcaggtgtatgttccaaggggtccaccatggaaaacagagacattcctatcacttgggaaattacaaaagtttagtggttacctcccaggaaccggggaaaaaggaaagccaatttttttttatgacatagggataatgattatgcaccctaagttgcttagtagatcacccaaaacatggtaagtggtccataaatatttgctaaatgaataacagagtgaataataaaagtcaagacaaggccattgttttaaccttatgaaaggagagttggccaattatctttatttttctggatagatttacttctggcatttgaagccctcacatctcttgttctatttccttctctactttctcctattttcattgagttcatcccactatcaccatttcttactactgtgaaacagactttgaatttctacttaaaaccctgcttttgcctttcacaccttttcaatgggattttacagttctgagagctgaggaagtgaaacagaaaacactgtgtaagaaaatcaaattcttctctcagtaacaaaggtgccttgatgcaggacagcatttcaattatggtgttcatttccttccacattaatgtcatttgagttgccactccattacttattattagtcaaatcaataaacaacatgcaggctcacaactcactgcatgtcaaactgaggcgtgcaggtggagctgttaatgcaaactgatatttcaggtgtcaaagggcacattggctcctgagcaaggtttgaggagtgcagtttggttcaacaaacaattattgagtgccttgtatgtgtcagatgttgtgctgggtgccaagaataccagtactaagaaggggcagcatcttcctgaggaacctagtgtcttagggagagtggggatggggacaggcagaatggactttccctctgaggtcctttaattcaaaaaaattcttcagggtctcttcatcaccttctgaagtatgactggtatacatcaaattgcatttattctactgcaccctgacactcctcatctcactttcctgctttatttttctccatggtactcaccaacctctgacacactatgtaatttgcctattggtttatttgcttgtctctcccccagctagaatgtaagctccatgaaggcaagtgtttttgtctagtcattcatagctgcatgtctagttttaaaatctgggtctggaacatggtaggtgttcaataaaaatgtgctgaattaatgaacgaatctactaaacagggggttcctcctgctgcccaaatgtctaagactcctcttgggtagtgaaaaagttgaaaagacatttatagtgcaatgatcctccagagtgggctggacatgttccttaagctgccaggccgcagggcagtgtccatggcctcagggagccggtgggggggaaccaatatgcagtcaaaaccagacaatataatgtgtgttgtctcattcaacccttgatgtatccctgtgagatagaagttattcttccaatttcagaaatgagaagatgggtggtgaaatagcttgcctacagccccacagctcatcagtgctagagctaagctttaaatccatgcctgagagatgccatggttcatgctttcctcatctatgatgttaggctgcctctatatcatatcttagtgaatgtgaaaagtaagcaagatgcatttgctccactagaagcacccacagcctaagctagacaaatattcacagaggaaaccacgttgattctgtaagatgggaccatgcacccctttgcaccattcaaagaaggctgaacagggcagatataaaaatgatgcagtgaatgagctgttggcttccctcatctccctattaactgtgccctggtgacttactcttaagagacatcaaatgaggaaataaatggctattgccaaataaacaaaggcaatgttttaaaagtctctgtcatgtcctgatagttcctgacgatgccactaagcccatttcaactgtcattaatcctagtctgactcattctggttaaggactactgctcccatgtctgagccaacaatgccccaggaaggtactaggttaggaaatattccatcccttgagcaggaagaagactctgaaaatagtatattgtctccatgccttgcttaaaggtggactggagttcacataacagcttctttaagtaaccatgccctctgcactccccctaaacctccttgccactttgtggctatttttcttggcagctagtttttactcctttctttcctgtgctcttctcatctcacttttatcagtgtttccccaaaagcagaccatgcttccagtgactcctcagccatgacagtagatttctctgtatctacagcttaagcaactagctgatgctaagacctctgcctcttaattgcccttgctccttctgcaccctggacatcattgctgaccttcattgaactaacactcaagatacccgctcgactttataattcctggcttctcctttggaggtgacagggcttccttacccttcattataccacttttagggtggttggctagtcaaccactgaatcaatccagatgtcttctaacatagtcacatggtttatgatgttttattttgtaaagcttagcagaaatgtagctccatatagtggttttcaaaccctataaaataatactgaatattttaatgcaagttagataattatcaatataaaaattaaagggaaatttcaaaataatggtaagaacagtttctcagaaatagtctccttaattcagaagttaaaactcagaagtacctggatcacactgagcttatggatccccggtatgaggaatgaacacaatggtttatttctgtttgattggcaatgagattgacatatttctttggctcccctgtgctattaaaaaaaaaagagcctctaaattgagactactgcccatttcagtaagaaatgaggccacatgtcaatagaatataggtaactacacatttataacactgggcagtgatgcagaattgattagcaagtgtaattgcagtaagtaagatgctttctgctcctggtactgatgactcgtggcatattgaaaggaaaaagcatgatgttcaaggaaatgagattctcaatattaagatggggtctaaaagtgcctaaatagaattggaaataacctaagtattgaatgagactgtagagtgtaatggttaagagcatgggctttaggggaagacagatctgaatgcaaatatctgttttaacatgtattagctttgaagtgcagcaagttctttaaattctttaagtctcagtctcctctataatgagacgagatgctcacagtgtttattctctaggtggttgtgagaattaaagcgatgttgcaggtaaagcacagactgcacttgtcacacagccagtgctaaaacagacaaaccaaccaaccccaagcaaaaaactatctatattgttttcatagttcaccagcaattccagttcctggaaggcaaccagtcagtgatctactgaagctaagtcagtctacggatgaggtgcatgtctgtaattgatcagattcagacctagagggaattggtaatctggtcccctcaggacagaatgtggagttctgcctcatgaactcaatctgtaagtatcaggaaaaatcttcccagaatgggaaatgtaaaaagaaagttccaaacatgcctaattatttctaacagattctaaaaacctctcaaaatgaattctgcataaaatgtaaatctaaacagtttgatgatgatccactgtttctacattattcagtctttaaacataaataagcctaggttttctttaaacaattctatcacagagttcaaataaagcaggtgtaacacacacacacacacacacacacacacacacacacacaaagatattctactttagctctctcgtatctggaaatcattcatcttatctgctgctcgctctccctctttctttttaagtaaacattaatccccacagatggtgaaccacggtaatctctgctaccagctgcagagaagaatttttaatgaaatgggaatttaaagggttttacacaaagcaccagaatctattccgctccttctcataatgctcaaattatttttactgccatgggttataaatgcatgtttgtattactgcttctgagagaaactgacctattgcttagaaggtgcttactgctttaagcgtgccgtctcctgcctcacccagtataagggtgtcaagtccccagtaaaaggcactcagtggttaagattacaagatttatcccagaactgaccttattttacactaccaaccctgcccaatctccacctgacttttgttgatatgtctcctgatcttctggcctcccttttaataaactccacagagttgtggctttgatttagctacatctctaactgaaagatttgattcctgtttttttctctccctagtccagcactgctcagactaaccacctggtattctgacatctcctgcttggccttatgaccttcctttacaaataacacttatgagcagctctgttggacaccactcagtgtttatagtcaccagctctcctcgattcttgcccaagagtgttgatatagaacactcatgatcattctcaaatcttttaagaaagaaattcaagttagctatgaagccaaaagtttttttgtttttttttttttacaaaagatgttataaaaggtgacatgcacacacaagtataaaaaatggaaaatcaagataatgtctaatttaagttaagctaattacttttgatgaaaacgtattactttaaaaaagatttatacacctctaaagccgttcaaaatatatcagcatagaaagattttgatgctcataataatttttatatataaattatcaggggggaaaagtcaaactccaatagaaaaaggactattttcacaaattaagggtacacatacaagaagaaaatattaataagattaagaagttcatctctattgatgttatgaaaatttcagccttgaacactaacttatggccacaaatccaatcataaaccatttcaaatggaccaggaaaagaccccaatgtcatggaaagagtagctgcttgaaggtcagaaagcctaagagctggtcttcctggtcctgccatcaactcactttgtgctgggggctgagttgctaggcctcttctagactcagtttcctgacgtgaaagtttactcctgaggcctcccaggtctgtttaatatgggatcaccaggaaacaacataaaacacagcagtaaacttaacaggagtctccctgtcagatccttgaactgatttcacatgaagaacatttagaaggcaggtttcagaaccctggacagagccattttgactcagaatgaggcacggagtgaaagccatttaggctgggtatagtggctcatgcttgtgatcccagaactttgggaggctgaggggagaggatcacttgaggtcaagagcttgagactagcctgggcaatagagcaaaccccctgtctctacaaaaaatagtaatataaaaaagcagtttgtctgccagagtaggaaaaaaatcaaaggacaagaaaatgtctgaatgtcaatttttaggaagactgtcctcaactacccaaagtggtgtttcttactacattatttgtgctcctaaagcactgtataaagatgtctattagaacccatgttaacatccctggcaatatcatgaacttcttaaagcagggcttctcaagttttagtgcttgtccgagtcatcacagccaatcctcagaccttcctgcccaaaccactctttaattagtatttactaaggccaatctattgctgcatgaacttttaggattcaagaatctgacatacagttatgatactctgtcttagcctctccttataaggatgttgacagccagaagaatcacattgaatcaaagccagtgatagaattctgtcaatgactgattatacttatacagttagcagcccctcctaggagattgccctgttgatccaagaatcaccaagagcttttcctgagccatagctttatagggcatgctatgctattttgcccatcatgaaagagctggcagtccacaaataacctgagggcaggatcacactctaaagtgacttgagcaaatgatttgtgtaagctaatgtgaacctcctatggctgtgctgtcatcaaaacactgggtcaaatcaaataagtccatcaaggtgctataaaatatgcatgcaaagagaatggatgtgatgttgttgagaataataaaacagtccataaaagctatgaaataaatcaactgttctttcaggcatggaatacaaaacaccacatacatccatatatattatatatgctgtaagcacacatttattatatatgagcacttattgacatgctagagaaaacaaagtgattaaggtgtttgcttcgtggaagcaatcgccatcaaggaagcattggcacagggactgaaacaatcctttgccctctgatcaatggctttgccaaggataatctcactggtgaacacttcttgtggggaacatgtgtatccctagaaaggatgaattacaaataagaaatacagggggtggtgggattattcttatgccatgactcaggcagctagctctaagatgttctaaagagattcttcgctttcctctaaaaacatgtttttaatatcagatcatggggtgaaaatgtaccctcacccttcagacaaaacattgaatggtagagatttcttctctttttccacccctccctccttccttctttactttcttcccactttacttttttttttttttttttttttttttgagacagagtcttgctctgtcactcagggtggagtggagtggcatgatcttggctcactgcaacctctgcttcctgggttcaagcaattctcctgtctcagcctcctgagtagctgggactacaggtgtgcccaaccatgcctggcttgcttatttatttatttatttatttaagatggagtttcgctcttgttgcccaggctggagtgcaatggcatgatctcagctcactgcaaccttcgcctcccaggttcaagcgattctcctgcctcagcctcccgaatagctgggattacaggtgcccaccaccaggcctaatttttttttttttttttttttttttagtagagacggggcttcaccatgttggccaggctggtcacgaactcctgacctcaggtgatccacctgccttggcctcccaaagtgttgggattacagatgtgagccatcgcgcccagccacacctgggtaatttttgtatttttagttgagatggggttacgccatgttggtcagcctggtcttgaactcctgacctcaggtgatccacctgcctcagcctcccaaagtgctgggattacaggtgtgagccaccatgccagcccttccttcttctttaaactttttttttttgagtgtactttaataccagttgcttctctacttgctatataagcaatgtcagcattacttactgagcatgtgtatgcgacagcccttttctatgtaccagagggtcagaaccacagacacaaatgaactaccaccactaccctgagagagttcatcatgtaccttcaaagactcatgtgtaggcaactaatgcaaatgccaagaagaatgaaacatgtaccttaaaagataatataaccaaaggaagaattactaatcccaactgcagagattttgggaaagggtcccagtgtcctgtacaagatggcatttgaattttgactgaggaataggattttttttattggtaaagaaatgggaaaagcatacccaggtaagaaacagcacgttaaagacagagagcagaaaggcagtggctacacttggtcttttctatggagaatttctgcagtgcctgtgctcccataagtctctggctagaatggaaatacatttccttccttttgatagcacaaagaatagggtttattccacagagtgacttggaaccttagtcatagtgttttttcagctttattactcacctacctgtgataagggcctctcccagcaaagtgtcttgaatcactaaaagtttgtctctccttcgtagggctcatagttgacacaggggccagagaccaagcaagttcaagagtagcaccccaaaccattgtttcttcagaaattatcagccccatcccaccagatttatgacaaacctacggtgttcttcccccttcagagacctctttgtatctctctgctatctgccttctgtcaagagatttccagtgtttagacatctcaatacatgtcagaactccaaatgtagaaaggattcaagtctccttgtaagggtatactaggtcctgaacaaatagagaccatttacagagctgtctggagctggctcatactagcttgcaagagccaattgttaaattttcaggaattttgcaaactggttaataccatattggtagcttgaaattggccatggttggagaatttatatcacagagactggtaaaggctacaaattaggactcttatttccagggagcttattgttaggttcttgccagtactgcaccaagtatgtaactctaaatagccctcaaaccttccacaccagttagccaaaagcacctaagtggctttcagaggattaccatcttactccatatgcatggaatgttggtgtctcagggagtgttgagagatatatatcaacaatggtgctgatcaaacacccactgtcaagagttcaatgtgctgtaggagaagaagagaagtgctggagtttagtttctaagcatgctggctctaatctttactaactgtgggatttgagggaagttatttaagtctctgcattgttttttttccctcacctgcaaagtggggaccataatacttatgtaacagcgttaaagattaaataaaataatatttgaaggtacttagaacaaggtacagaacagagtaagtacccaataaatgatgacaatgaggatagacaactaggttcaaatgctggcactgctacttttcagtttgtaccatcttgttaaacttatttcacttctctgagcctcggtatttttcctataaagaattggaaaaacataaactccttcacagagtgcagtgcattaggtagttggcactcagcaatcgttctatcatcctgatctcagtattacaggacctgggaggcaaaaaactacatctcccacactcccttggagctagcattcataagcaaattaggttccaccaatacaacgtacttgtttgaaatgtagatgcaagagagaggccaattttttgctttttggctttctttattggcaagcatggctgtggagatgttgggcttcactgcagcacaattctagtgtccatgactggccatgggtgtgctgagaggcaattgtgctggctggggtgggcctttggttctgctccttttgactgtggcagtagaagcagctctcctggtttccacagtgttgttctgggagtcactctgagtgtccagcctagtgtttttcttcagcccacccaatgatgtaaatacacatttcactgcctaaaatgaccaaaaacgtgtttgtgttctgcaactagaccctgattgataagcagtgtttgggaggattacacaagcacataggatagtgcaccagacctgcaacacttactattgtgcctggcttctattgtgtgttcttaataaatctgagttccttttcttcccagacttgtcaaccctcctttgtcaatggaagaaaaagacccagttaactatggcttttaatcagcatgacttgttttatgaacttcctgtgtagagtgtaggggaaatgtatatatttgcttcctgaagaatccagaccaatgctctaagtccatttttgtacatataaatacttgaaggataccaaacaatattacaagactgtggctttcatggccaggactatgtggtatattttccttgagagttaagaatcaggtttgggttcatttatgcccattcttagtggaggttttgtccaacccctaatatcatcttattaattccattaaaaatttctcatctgagcatctactcttggagtaattattaaaaaaaaaaaaaaaaaacaaaaactgaaaactcagctctcctttatctgctcttttattcaagtcattttcaaatttgtttcccaggcaatagtaattgtttcagtaattaaaatgtcaggaggcgggcagagttgattagaatagcctctgaccacatgcaccaggaaaggcatatgagagagcaccaggtgacctcattattaacgtggtctattatattaaccttgttacacatgtaaaatgtactgaaaacattgatactcagctcttccttgttttgtttctgatacctcaagcaatagcccactattagaattaaccactgcaagattattacaaaatgaaggacagaaaaatgaaatgtagatatgagttgaaataactctaacaccaaattcagcatctatttctattactcatatagagtgtctgttttacccaaggctattgcaacttaaactgggtctttcctcctgttgacatgtctccacgcttacccttgggcatcctgtatagggtagggtgaggggtagtgagtaaggaagatgtttttcttctgtttttttttcttttttttcttttcttttcttttcttttcttttcttttcttagggtctttctttgttgcccaggctggagtggtttgatcatggttcactgcaggcttgacctcctgggctcaagccatcctcccacctcaacctcccaagtagctgggactacaggtgtaagacaccacccccagctaatttctaaatgttttttagagatagggtctccctatatttcccaggaaccaggagagctgcttatactcttatactgcccaagttagtcttgaactcctgggttcaagcaatcctcccatactggccttccaaagtgctgggattatgggtatgaggcactgtgcccagcctagaaaggcagttttgacctggatctagatctgtgttcctagactgatggagaaccatggtattattagaaggttaccaagtcaccgtgatacacttaacactttcaagagtcaacacaatggaacgacaaatacttttgaacttaaaagtcatttaagctctgtttacagctcacagtccttcttcatgtggaggcagctttatgcaatggggaagaaggctgtttctgcagtcattctaatctgggttctattctttatactgcaccccaatctctgggacagagacaagtctctcagccctgttcttttgtgtttttacttatttttaattttttcaacttaaaaagttatttatattactaaagtttattttttggggggggtatatagttaaatgagttttagtacatgtggattattgtagccactgccaaaatcaggatacagaacaattccaacacccccaacatttccctcaagcagtttcttttaacttaactccccttcaccaccctctgacacttcttactcctggagaccgctgattgttatctattcctatttcttttttccagaatgttctataaatggaataatataaaactttttggagtcagtttccttgacttagcacaatgcctttgagattcatatatgctattgcatttatcaatagttcatttctttttattgctgagtagtatcccattgcatggggaccatggtttatctgtttaactatggaaagacatgagagttgtctccagttgtcagtgatatagataatgcagctataaacattcatgtgtaggttttatgtgaagataaaattttatttcttctctcgtttttttttttttttttttttttttgaacaaggtctcaccctgtcacccaggctggagtacagtggcatgatctcagctcactgcagcctggacctctcaggctcaagcaatcctcccacctcggcctcttgagtagctgggactacaggtgcatgccaccacacccagctacttttttttcatctttttttttttttttttggtagagatgaggtctctctatgttgcccaggctggtctcaaactcctgagctcaagtgatcctcctgccttggcctctcagagtgctgggattacagcatgagtcagtgcacctggcagtttttatttctttagtgcaaaatgtctccaccttgaatttaaagtggaataaccctttgttgtggggaatgtcctgtgcattgcaggatgtttggcagcatccttggatctatccattaggtacccgtaacagcctctgaaccagttgtgaaaaccaaaatgtctcctcacattaccaaatgttggggggcaaaattgacttcagtgaagacttcagtgaagaattcagtgacttactgaagacttcagtaaaaactcataagcaagatcctggtccatatggtagtatatgtttcactttaaatgaagctgccaagctatttttcagggcatctgtaccattttgcattcccccagctatgcctgagagctccaattgttctgtatctttgtgagtacttgatattagcaggtttcttaaattttttgccattctgtaattagggagtcccttgattttaaaatcaggaacgacaccgtggcaaatattagtgcatgcagctcactaatatttctagttctgaaattctcctcacttgagaaagtttcatttcctgctccttttaggttgcatgtgactatatgaattggcttggctagagtgaaagtggggtgggtcacttcatggtggacatgtgtaggagctgttgcacactgctccatcttccctcccccaagctttagcaaccacctacagtccagatggtggagatgtcatcagccaatgttgctgagtagaaatgacatggaagagagtaccctgccaaacctcaaatggacatgaggtatgtgtgagaaataaaactttgtttaaatccactggtattttgagattgtttgctagcttattttgactaaatcaaattactatgtgatagactcattgtgagcatttatgtgacaaatgtgggtaatgcatttaacacaattcttggctcaaaaggagttcagagtgaatgattgctactattataactatttactcttccctgaccatcccgcatcatgatgattctctctttgataaactcacagcttttactctctgtaatgcattagcagaactactttagcttcttcaatgcaccttggcaataaatcaaattcaaagatatgaagttaagtacccatttcattgaccacctgatcatcaggtgtgctggtacaccatctaaggttcaagggggtagcatcactgtattggtgcaaacatctctaaatgacaattagtattactaagtcattttaaaacctgtcttctataggtcagtgtatagaaggtctttcattaaccagcaactttttcacattttttgtctatttgtccatttcctaagaatataaagagaggtaaagaggtataaaaacacagtgattctcggctgggtgtggtgactcacacctgtaatcccagcactttgggaggccgaggcagacggatcacaaggtcaggagattgagaccatcctggctaacatggtgaaaccccaactctactaaaaatacaaaaaattagccaggcatggtggcacacgtatgtagtcccagctactcgggaggctgaggcaggagaattgcttgaacccagaaggcggaggttacagtgagccaagatcgcaccactgcactccagcctgggtgacagagcatgactccgtctcaaaaaaaaaaaaaaaaaaaaaaaagaaaaaggaaaaaagaaaaaaacacaatgattcacaaagctgatagtgcatcagaattacctccagaaagttgggaattctggttctaagatttaaccacactgaggcctaagacttaacatattttttaaagttctccatataattctgataagtagacaagttcagaagcccctgcattagttgtagaaatgtaggaagtatgaccctaagaaacttggcaagacgcagaaaaactcctgcaattaccccagctatttagagatgtgaagagtttctattacctacctggcagaatcacaatctgtcataggatatttttcacattattgttcaagattgaaatgtatccctggctctgatctaactggcagacagacctgaggaagagaactcaactctgtaggcaccagggttcatatctgcaaattgtgtgagttgggcttccacctataaaaatctttgatccattatcttctgtgatccaggtattcattttaattactcaatcagattattgcatgtattgaggaatcttctacattttccaggattttaatacataatatgagccaaagaaatgtttttcaagcttataactattcattcactgacaaacagggtgctcttccaaggaactctttttcaattttttcatgttcatatatatatatatatatatatatatatatatatatatatatatatatatatatatatatatgggtgtgtgtgtgtgtgtgtgtatgtgtgtatgtgtgtttgtgtatatatatatataatgaacaaatataacaataaaattctataattcccaaatctcaaaataaccacttttggcattttagattattgttttcatttttaaataaaaacatatactatataactttgtgactttcctttttattttccattataacatgagaatttccccatgattcaatttattcaaaatggaacttaaacaactgaatagtttcttatcagttggttatcacacttgtgtagccatttatctactgtcagatatttcaggtggtttctaattattgtccactgaacatggtgttacagtgaattttttcatgtgtagctctatttctttaggataaactaccagaattggaattactggggagacaaatactacaaatagctgcataagcctttaaaatgtcctattttaattattttcttcttctactcatctttcttactgctcccaagattatctatctaacccagagattctactctctattctacttcattaaatctactatgggatccccattcaagacagtggagctgagcacacttatttgataactccagacttctcaatattattaagatgaacaaaaaggtctaaaataaagacctacatcaacgaaaactctagaaaacaggagtagatagaaacgttgagaaacttctgaatgataaagagcaagtaagataggcttggctgaagtgaggaccagagaacagagtgtcccaaagctgaccaatgaaaagctcactgcagagaggtcattgctcccaacagaatcctggagaaactgtgagcatgaggagcagaaatgaaatgcaaaaagtcccctattaaattcttcttatccacattagggaggagaattcttctaaaaagaaaaggaagtgacatgtgtccgtgagtgaacttcactgaccaatggcactccttgagtgaaggtgtattaatcatgtcttctattttctgtatgctttgatatctggggcctaggtgactcaggaggaagtgcccctccaagggttagccaattcctagacataatgaacaatttgcctctaagcatgcctttcatatgcaaactggccaatccagaatccacacctcaactatcttctttatagggctctcatactccaggccactaaccacctgctctaatcaccccagagcctgctgaaactaataagccagtcctaaccctgctttccttgccttacctcttccagcagaaaccgtaataaggctcttccccatagttccctcctccctttattcctcctgaccaaccctggtatgtccccgtgtggtactgagtagattggcatgccccttcctcttgggaactgtcagcaaaaaaatatttttttttctttttttttgaggcagggtcttgctctgtcacccaggctggagtgcagtggcatgatcttgcctcactgcaaccccatttccagggctcaagtgatccttcctcctcagcctaacaagtagatgggacggcatgtgccaatgcacccagctaatttttgtatcttttgtagagatggtgtcttgccatgttgcccaggcttgtcttgaactcctgggctcaagcgatcctcctgcctcagcctttcaaagtgctgggagtataggtgtgagacattgtgccctgccacaaaatgtcttttccgtggcaattattttctaatctgttgggctcactgcacctcacatttttaataccttcccaacttaactgttgactccctgccaatctcctataggaaatcttatttattggcatatctggtaagtttcagtaataaaaaaaaataagtaatgaaagacttacgtggaagcatgaaaaaaaccaatgttcatagtgcattgatagatgaagaaagaaactaaaagagggagcacagaacttatttctacaaatatatgtagaaatgtagttgtatttcaaattagtggtgattagacaatttatttaatatattgagtaattagaaaaaagttttatcggccgggcgcgggtggctcacgcctgtaatcccagcactttgggaggccgagacaggcggatcatgaggtcaggagatcgagaccatcctggctaatacggtgaaaccctgtctctactaaaaattaaaaaaaaaattagccaggcatggtggctggcgcctgtagtcccagctactcgggaggctgaggcagaagaatggcgtgaacctgggaggcggagcttgaaatgagccgagatcacgccactgcactccagcctgggcgacagagcgagactccgtctcaagaaaaaaaaaaaaaaaaaaagttttatccttttatcatacaatgaactcaaaataattttgagatagattacggatataaaaaaccataatgattaaattaatagcataatgtttttataatcttatgctaaagaaggatttatcaataaaggacgaaacccaggattcacaaagattcatgtattttgtattttaaaaatggaagctttggtacaccagcaaaagtcactataaacacattcaaaagacaaatgataaaaaagaaaaaatttgcaacacctaaaacataagaatggttaatattcataaagtataaaaacataaaaatcaatataaaaaagacagcctatctgatagaaaaaaagaacggggatatgtataggcaatttacaaacaaatacaaaaggcaaacatatgaaaaggtgatgaacctcactaacaaggagacacaaattcagtcaataatgagagggcatttttcccatattaagttgtcaaaaattataaagactggtaatatccaggtttggcaaagctgtgtgggaggtgggtaggaacggaacatctttcactgttaatgacaggagaacagctttggagaagacaaataggcagaacccatctaaactacaagttagtgagtttttggtttggcaatttcacttctaggcacatatcctattggaatgcttgctcacatgcataaagacacatgcgcaaaatgttagaagctatatgatttgtaatagtaaaaaagtggaggaatgctaatggttcatcaatagcccacagttgaatattgtggaaaacttcgcagtggcaacaaaaaaaaaaaaaaagaaaagaaaagaatagagttacacggcctgactttaaaatagatgcgtatgttatgctgttggctaaaaagaaagaaaagttgcaaaatgatataacatgtacagtattcgctatgtatatatgtgtttataaaaatattttataaaagatagctatttatatatacaaaatataagtaattgatgaaaaactgtttcataaaattatcgtgttatattatcatatcctttttcatttttcccagttaatcatttgaattcccataagccttagtacaagaaaatccaggatctcccacttgagattgcctatccccagaattgtcccaaaacctcagcacctcattaatgccaattgtaaattgtgtgtgtgtatgggtgttgggggaggatggcaatccatcttccagattcaaaagatggaactaaatggggctggctttctccaggtatcacctgactacatcgacctggcatagtcaagtctatgatggtaacacttgactgtgataatgccgcctgatttaggatgtcaagtacttggtactcatagggtgatgctccctatggcttttgggctgagttcagctgtgagtgtggctctctgtgctcagctctcttgttcctacacaaacaacttcacgggtctctgccagccagagcaccgagtcaagactggaatttgtcagcttacagacctaaccttgccatcctccttccctctctagggagcctacaaagaggtccaggaaggttttctttttaaaatgtcagaagttgctatttgttctcctttctcagaatagagtaatagtttggcacttctctcttgaaaaaagttgtgctcccaacagatataatcctggctgggtacatcttgggtaaggtactggtggaaaattttgtttgtatgatagattttatgtgtacagtgcaggtctagaagaattcacactaaactattagtggtgggtcatctccttttgggaaggcaggaagtaatgggagtgaaactaagtaactactgtcagtcacatttactccttagcactttggagtaaactgtggtttgattttattttgacagggttaacaaacttggacatacacacacatacataaacactcatgcaaatcaacttaaaaataatacaataaattttctttctctcttctaatttttcgttttctgttggatcattcttctctgtgtatactcaatgttctgttattcttcccaacttaaaaaaaatcccctcctgatcactcttcccacttgtgcttttattactccatttctttgagctttttacattaaaagtcctcaagagttatccatattcatttgtaaatcctttcctcccattttctcatgaatatatgctaatgatcccccatcccactcacttctactgctcttgttaaggccactaatgaatggcctccaagttgttgactccgtggtcattttcagtctttaccatacttgacccatgaacagctccttctgcctgagaaccctttcttctttcatcttccaggataccacactcttccagtttcccagctccctccctggcagctccatcttaagttcccttcctgattccacctcagctcctccccatcttaatgttaggtgctccagggctcagtccttaagccttttgtctaacatgatttcattagccatggctttaaatatcatctatgttaaatacacctcaaaatttttcttttagcttaaccctgtccaggattctaggtttatacactctacctcctatttggggtctccacttggatgtttgacaaatatgtcaaacttggcatactcaaaactggctcatctcatggtattctctcccaaatctgcttttcttatatttttctgcaaaatgataaaggataacttcaatcccttcatgctcaagagaaacccttgtagtcatccttgacccttcttttttctttgcattccatatttaacctatcagcaaaatttgttgactctaccttcaaattatatccagattctgaatacttctcactagctcttctgttgcctccttgggtcaagacacagccaccctttccctggattgttgtaatggccttttcactggacacctggactcagtctttgagaaccttcagtaattttcaacacagagtgatgctgtaaaactctaaaacagatggccactttgctcgcagccctacataagttcctcattgtactcaaattgaaagcaaaatccttgcaatccctctcacctcattgccctctactcctccactctccctctccagcctccaagctttctctagaacgggttgtcttgagatctttgcatctgctcttctccctgcttgggctattctcccctgcaaacacccaatggcttgcaaatttaactcatccaggtctttgactttatgttctattctcattgaggctttccatgactatggtatttaaaatagcacacagcttctcctaccctctctgtatttccgaaccttttcagcattttcttcttcatagcacttagtacaaaatgattagtgtcctagtgctgtgttacaaattagcacaaactgggaggcttagcgcaaactgggaggcttagcacgacagaaaagtattgccccatgaactgtgaaatcaaggtgctggcatggttggttctttctggaggttctgagggagaatctgtgctgtgcctctgtcctagcttatggtagtcaccagcaatcctaggagttcctttgtttgtagacacatcattccaatccctttcctccatcatcacctggctttcttccttatttgtctgtattcttgtatcttcacatgccctttctctatgaggatatcagtcattgaaattagtgcccaccctaatccagtatgacctcatcttagttcgactgtatctgcagactatttccaaatgaaatcacattcacaagtatcagggattaggggttcaacatatattattgggagagacaattcaacccctagcaccatatgacatacaacatatttttacttcattttttgtctttctctttatacaagaatgcaagctctaagaaagcccagagttttgtctgatttttttttcactgctatacctgggtgggatgcaacccataaagacttgttgaatgactaaatccctctgctagctcctcatgaccaagaggacgaaggtccaaacaatggatacagcattcatgctgttagacaaactgggcctcactgaagttttcacccttagctttcatcacttccctcagtatctcctgtttctactaaggtgaactcctggatcttactcaaacacgttcacaactctccttatttgctctttctctccccttcacccccatctactcctcttttcctctacaacacatatttctctgttaaaatcttacacattctcctaagaccagctcagttctcactctgaaaccttccatatgaacagttaacaacctctttttctgggtccctttcagttagttattatttttctcactagaaattttatcatcttagcacatgagtgcattggtgtagaatcatgacaacacaaatcttctccattcaactgggagatctttcagacaggggccaatgccttccttatctcttcatttttccttcagtccaacccccagcatctatccagtgcttggactgtaacagctgcatgctaaacacctgttgaccaaatgaaagaagtagggtagatttgccttcttaagctttgaagtaacagcaaatataattttggccactgggccccaggatatatgtactacatagttagccaataagtaggtgggaaagatgaggtttctaactaaggcattttggaagttacaataaacaaaagccttcgagaaaaggccttagtcatggtcagagagtgcagagagattagcaaaggagaacacaaaatagactactcaggaggacaaaaaactggacttaagctgtctaatagctaatgcccatccagtaagtgaagggcagaatcctcccacagccacctgcattattttctaaagaccatcccttagagctgtttttagaggtattttgagcattgtgggtgaatgtggcagtgtagtcttagatatagatgagaaggagtggctataaaaactgcaccttccaactataaaaacttcctggagtaacaattccctcccacaatgtaattgaaaagtgcaattgatcttatctttaaagagtgttctacaaaatcttagagtcattctgttagaataacttgaatgcttttaaaaaacctaattcctgggtctcatctaagatgccctggaatcagatctttgcagtagtgtactagaatttgcactggcaataagctcccaggaaaatatgagaatactaatatttaaggattcctacattaaggaaatccatccctaaatccatgtatatgatttatcatggtcagccattgtgttggttaattttatgtgtcaacatgactgcactaacggatgcccagataacaggtaaaacattatttttgggtgtctgtgtaggtgtttctggaagagattagcatttgaatcagtagaactagtaaagaatattgtcctcacagaatgggccagaattatccaatctgttgaaagctcaaatagaacaaaaaggcaaaggaagagtgaatttgttctctgtttgagcttggatatccatcttctctcaccctgggattttggtacttcttgttcttgggccttcaaactagaacctggacttatgccattagctccccgtgtgcaccctgctccattctcacgccttacttatgccatcagctccccctgtgcaccctgctctattctcatgcctttggacttgggactgaatcacaccactgtctttccaggttctccagcttgcatatagcagataatgaaaattcttggcatccctaataatgtaaaccaattcctataataaacctcctcatatatatatcctataagtctgtttcagtagagaacttcggctaatacaatcttattcttgaaaatctggaaaggaaaaaaatgaaaaaaaaaaacccacaagtctttgtatagatttgtcttcaagttagggtcttcttaaataccccctccaatagaactgctcttaaagaatagacacgcagaaagaagcctctaggctgaggcaagcaggcccacaaggctgaaacacagaatggaggagagcagcagttcttgagagcttgttagcaatcaaacctgaaggcaggcggggactctgagatgagtagaaactctgggcagccattcagtatacttttcagcaacccagaactaaatgtaggcttcagatacagagttatattatgggaacagcaaagtctttggactaacaaataacatggttgggatccttgctctgccaattacttttggttcagcgaatctgggtaagttatttacctcagcctcagtttccacatctgcacaatgcgaacaacatcaccacttggctggcttattgtgaagataaaataaaataaaagtgtgtgttggctgggcgcagtggctcacacttgtaaccccagcactttgggaggctagcttgtaatcccagcactttgggaggccaaggcaggtggatcatgaggtcagcagttcaagaccagcctggccaagatggtgaaacccctaaaccccttctctactaaaaatacaaaaaaaaaaagaaaaaaaaaaaagaaaaaaaattagtcgggtgtggtggcaggtgcctgtaatcccagctactcagtaggctgaggcaaagaattgcttgaacccaggaggcagaggttgcagtaagccgagattgcgccactgcactccagtctgggagacagaatgagactccatctcaagaaaacaaaaacaaaaacaaaacaaaacaaaaaaaactgtgtgtgatcacttcacatgatagttgaaacttggtaagtccctgaaatatgacatcttctagatttcttttccttgtctccagtaagagataatcagaaggtggtattgatttttaaaaaaaaggagaagaaaggaaagaaggaagggagagaggaagtaacaaaaggaggaaggaaaaagaaatagaaaaaaagaaaagatacacaaatagaagaaaattagcttggttcagagttttccagacaaaataagctactttcaaatatcatcttttactgaacatttacattaaaatctttaagcggtacaccatgccattgtagatttctccaaactaaataaaaatggtaactaaatagtagaataaggattactttctatagctgagaatgaaataatttgaaggtaaacattggaaagctcttaaagcatcctaaattgtcttttcttccttcaaatgtcaaaatacctatctcaatagatatttttaaattgcattcctctttcaagatccttctatcccttgtgtctcttgcttaggaatgaaataaataacttagttggaaatgacataatctctggtaggatgggagaggagtttaaataaattccaatttgaccgtcttctagatcttggtagatactgataatgctttgccactgagatttgtggaaactggagagaaaaataatctttgtagtgtgttctgctgttcccattacctattgctacataataaatcatcttcaaaattcagtggcttaaaatagttatttattattataactcatggttccatggattgactgggatcagctgggtgactctcacttggggatctttaatatggttgtcgtctggagatacattatgtgaaggttctctgggatggctgtctaagatggctcactttcaaggctgacagttgctcttagaagttggccgggagctcagctggtgctgccaatcagaataacaacacatggcctctctaggctttgtcttcttgggcatggtggctgaattctgtgagggagagtcccacaagtgggcatttcaagagacccaggtggagattgcaaggcttcttatgacctagatgtggaagtcatgcagtgtcacctctaccacattctgttacttatacagggctagtcaagaatcaagcaggtgggcaggtatggtggctcatgcatgtcatcctaacactttgggaggctggagaaggcagattgcttgagcccaggagctcaacactagcctgggcaatgtggtgaaatcctgtctctacgaaaaatacaaaaaaattagctaggtgttggggtgaacacccatagtcccagctaaccaggaggctgaggtgggaggatcacccaaacctgggaggtcgaggctgcagtgaaccatgattgcgccactgtgctccagcctagatgacagtgaggccctgtctcaaaaataaaataaaaccaaaccaaaccaaaccaaacaaaacaaaataaaataaaaaagaatcaagtgcacaagtacttgagtacacaaggacatcactactgggaagcatggttcattgggggccacctttggagactagctgctaggcttgcctacattataattaaactttcctacccataggagcatttctatctttgtcagatcaatagtagcatcacttaccatttaactacaaatttctaatggaagtttcacctgcatgtatgaaaacaaggtttccatcaaaggtaacaaaacaaatgaccaaaagtgtttttgctaaagaatttgtgaaagctttttcattagctgaacacccactggagacatcatgctttgagactttctgacctcaatccctagacagaaaaagagttggtgtctcccagtttgcaagcagtcctggggaagtaggttggcaccgatgaaccctttacattgattatcttaggcagctcaattcacttagttttcttcagttgaagaaaagggggtagcaacaccggataaattttaggggcacttctctcctgacattccattaatgtgccaatggcttagtgttttgcaaggaacttcacagaatagaacagttcggttaacttctggttgttgtaacgcatttttacttaataatctctcttgtctgtgtttcaggtcattcatggggatagagtaggcagggtgtgtagaatcttcttccatcacagcatgaaactgagtgaagacttcagaccatgacatctgcagatgttgggcttcagttgtgggttcgtaaattctcgagtttaagacttgttgccatttgctcaatatttttgatccttggcttcctcatttgtaaaaaataccaaacccataattttgttggaaggaacaaaggagctgaactttaagaccctaccctaggtctccctactactgggctattttgttgtttgtttgttttttttgccttttaaacctcgcttgaatgatttaatagttatggtgtacctgtagcttttagttaccacacatctctttgagaagtagtcagggtatgaataatacacataaataaaaaatgagtgaacagtatattaaagcaaagtaagcctgtttgaaaatttggactcaaaccatagtttcaaacccgtaaaaaatatttattgggtcactagtatatatagtgcactgtgctaggctctgtagaggactgaattcataaaagcaaaagctgcctttattctacttatccagaggttactgaatttggagctagttgacagttatgccaggagaacacaccagtctgcctgcctgtcaaggagagaattaaaaacttgtttctgctcagtgcacagcagacagcccggaaagagtcttatgaaccaagcactgcaaacaaggccatatctcctcctttccagatttttataagtaggtcaacaatagttcaggaaagatggaattccagatctaagaaaataattttgattgaaaaagatgcaaaaggcagtagagacaaataagagattccaatgattatcagtggtatttaaaacaaaacgaaatagcccaaaacaatcacatctactactacgcattcattaccacggagacactaaggatccaccgggccaaggtgccatgtggggactgaggtggtgtgtgtgattgggaggggttgttggtagtgaataatagggcttttagtaatgcacaaagggagagatgagacagatacccaaataactgtaattcaagagagaaagtgctaagtattaaagaagactgaagttctaaggaacgagaaatagcaccactcaggcaacatgaggaaaacctgttgaatggggaagtcagacttcagcctggccttgaaacagaggtggtaatagttagcgatttggtttggatgaataatagagtttgtgaatggaagaagtggaagaaaagtctggaaagaaggttgagaccagactctagagcatcttcaagattgatgtacagggtttacgttttacttggaaagtgttatcacgtaagaatgcagccagctgcaattgatggaaaaatagacagtggtttacatgagaaagcagttggtttactctatggaagaagaagtcaggaggcaggcaggtgagggttggtatggtggctcaggaggccatggaagacttaggctctttccttttgccccgccctgtcattctgcacaggtagctttcactctcacgatgggaatatgactgctcctcttccagccccatgtctgcactataagcaggaagaaggtttaagggtaaagggagggccaatcccctcccaagactgtcacctacatctcaccggtgaggaatgtatcatgccatccctacctacatggggggctgagaaattgagtattttctattttctgagtctttggcaaagaaagcccagggaaaaggtaactatgagtcccttttgagtagctagttcatggcattcgccagagaactattatggtttttgagcaggggaataaaacactgcttgatgattaatttggctgtaatgcatggctggacttggagagaatagttacaaagagaaagatgagaactcaaggtgcagagacatgaagtgccggattcatggtcctgtatgagtaagtggtggaactgggatttgaatccaggctagttgttcccagcctttttccacctatctctcaaagctactcagtaaggactttaacagaactatctcttatatagagccatctgcataaacaacaatgctaggaagccattaattcatttattccttcaattctgctttaattatgtatactgttgttttataaacaatcctgggagatagtataataaaaggaaataatgagaattcagagaaaggtagagataagttcaagtccagccatttctcttgccaatggtgtgattttgcatgagtcacataaattctctggctttcaatatccttagaggaataacaatggcagaaatgtataaaatgagataatcttgttatggcaaacatatggccaatatgggttagttggcccagcctccgttccaaatttattctccctagccaattccggctaaggcagttggtgtgttactattctggccaatcagacataggtgggatcagctatagtctcaatgatatttttacttttctgattcaggttcctccattttatactcctttcttcctgctggtgggcatgatggctggagttgatgcagtcattttagcacaatggggaaaagaccacgtgagtactagaggcttcattatgaataacattgaacaactggaacaacgctagcagctgcaaatcctcaaacttctcattatgtgtcaaaaataaactacttgtattagacactatggctttatttttcattacttccagttaaaaacacttaaaattgatagtttataaaagcacttggtacctactttatgcttaataagtgatgtttattattattcttgtcatcatcagtattattgttattgtttttataagttgcataatatcaagttacaggctaacagataaaaagactataatcaaaatacataaacaaatatgtgatatcctaacgaaaaaataaaaataaagccaccatgaaggattgagagtaacatgaaaccacactggttctgcgtgggtggaaattgtctgtacggatgttggaaaaatccacgctctaagtccgaagccagggttatagtaaagggcaatctttccagatgcagaaacatagcaaccatggcaggggatacgggaagggaagcatttctactggggtattttgagtgatgactgtaaaattagtgcttggactatacaagagggattttgtctctttgacttaaatacagtgttcagtgtttatggggataaaaagtagtcaaactaccaaagagagtctggtttctggtaaagaatttagaaataggaaaagctaaggtccatggaaatgaattctctgaccttcagacttctctagccaactactgagtgagataaactgataatctataatgtatgctaaattttcagaatgaaactaaagtgcaaaattgaattgtacgaacaatagacaccatgaagaattaaaaggcttattttttaaaagtaactccagtgaataacatagcccaggcatagatatgcttgccaaacaagcaattgacccagtaaacaacatggttattcagacaaaatcagagatcctgtatttgtgaggtcaatagatcaaaatttttatcaacttatctattgtctctatatattcacgtatacatttttgaaaaatatttgttacaatttacaaaaacacatatatggcaatagaataaacaataaaaaatttagaattcaagatagttgactatgcatgtctccaacctcatatcccattaaatgacataagatattcacaaagaggacaaaattataacaccactagaaaagtatagggagcttgtgtttggcagatctgaatactgaggaatttctgaaagctgtaaggcagatagcaacacattgactgagaatatcaaaaagctaaacaattcataacacaaaatggaagaaagaagaggctttctcagcaaaattctgggggactccaagatcagggggcagagaaaggtgagggatgactgaataaagagacctgaaagagctgtcccgttcaaaaggctgaccccacgtttgtcccccaagcaaagctgaaagaatagcttcctgaataaactggtgaatcatctgtgagaggtttccagagtgggcactagcattaaaaaaattgcagcactgaactcccaagtaactttgattaccataatgggctactaaaggataaagtgtcatacctcctaaagaaaagacttcccagtgccccaatccctgaaaggagccagggcttctgtcttaagaatttatacccattgttggagatacaatttttttcatgtaaggagaattacatttcaggaaccaattctattttcttagatcctgatttataaatgtaaataagtaattttattcctccaaaggaatgccaccctgttgacatcttgattttagccctatgaaatccatttcagattctgacctctaaaaaattaaaataatgaatttgtgttgtttgtagtcactaagtttgtggtactttgttacagcagcaataggaaactaatacacatggagaacagactcaatagacccaataactctgtagtgagaaatcacaaggaaagaaagagatacagatggagggtatgatgtaatcaaataaataatagaaagactgacttgaagctggaaagggacttgagttttcagagaagaaaaggccaactgagtcccttatggcaaaattgtaaaaaaattggaatccctaaggataaagaaaaatcttacaagctcccattaaaaaatacattttttggtataaatgaattattattctcatcactgagcccattatttatttgagctaagtattttactttaatcttcaccacaccaggaccctataccacactcttatctacttgcatgcggatatggaaaaagaggatccctgaggttatgcagttctacagttagtaagtggtagaaatggaattaaaagtcaagttcagaaacatgggattctgaagacaattacattatttgctagcatcaaacttctcatttacaatacagaaaacaggaaaacaacagaccaatgcctgtaaaaagttaaagaagtacgttttcaagctcaagtcctatcattaaagtatggggcagaggggaatgacatttttagacatacaagaacatagaaggcttaccacccacataaccttttctgaaaacaaagcaacaacaaaatcttcaggttgtacttcagcaagataaagttgaaaaacagaaatacataacataccaataaaatgagcaatgatatcagtaaaacttatagttaatactaagtaatggttgaaaatatggcagtgaaatttaatggaattgttaagtaggtagtcataaaacagaagaggcacaaagtaaaaaattaacaatctggaaccaaaattcaagataatttttaacaatatgaaagaggtagtaaggaagaaacaaagggaagttataaaataccaatgatacaacctgtattttgtttaagcgagattgttgtagacactgctttatttttatttggacaggaaaacaatttctgatttcggcaagtttaaggatgttcactagcagaacaaaaatgtaaggtgaaaatttcaaactactatgaggtaaactgtaaataaaaaataagaaattaaagaataaaaacataaaataagaatatatgagacaatataatgaatatcagttgaatttttctaaactattctagaaataggcaatgttccatgttatttttttaaaaaaatcaacttcatcaaggtattatttgcatacaataaaatgcacagatttttatttatttattctaagcttttatattgggttcaggggtacatgtgcaggtttggtatataggtaaattgcatgtcatgggagtttggtgtacaaattatttaatcagccaggtaataagcatagtacccggcaggtagttttccagtcctcatcttcctgtccccctctaccctcaaggaggccccagtgtctgttgttcccttctttgtgtccacatatgctcaatgtttagctgtcactcatcagtgaaaacatgtggtatttcgttttctatgcctgaattagtttactgaggataatgagttcagctctatccatgttactgcaaaggacatgatctcattccttttatggctgtgaaccaaggtgtataagtaccacattttctttctccagtctaatgttgatggacatttaggttgattccatgtctttgctattgtgaacagtgctgtgatgaagatacgcatgcaagtgtctttatggcagcacaatttatatatctttggttatatacccaacaatgggattgctgggtcaaatggtagttctgttttaagttctctgagaaactgtcaaactgtttccacagtggctgaactaatttacactcccaccagcagtgtataagcattcccttttctctgtaacctccccagcatctgttactttttgactttttaataatagccattctgactgatatgaggtggtatctcattgtggttttgatttgcatttctctaatgattagtgatgttgagcattttttcacatgcttgttggccatgtgtatgtcttcttttgaaaagtgtctgtccatgtcctttgcccacttttaaattttttttttaatttgtttaagttgcttgtagatgctgggaattagacctttgtcagatgcatagtttgcaaatattttctcctattctgtaggttctctgtttactctgttgatagtttcttttgctgtttagaagccctttagtttaattatatctgacttgtcaattttgttgctgttgcaattacttttagtgttttcatcatgaaatttttgccagagcctatgtccagaatggtattttgtaggttatcttctagggtttttgtggttttaggttttacatttaagtctttaatccaccttgaattgatttgatttttgtatataagtgaggggcccagtttcaatcttctgcatatggctagccagttatcccaacaccatttattgaatagagagtcctttctccattgtttttctcaactttgtaggagatcagatggttgtaggtgtgaagctttattttgatctgtctattctgttccattgttctgtgtgcctgtttttgtacttgcaccatgctgttttggttactgtagccttgtagtataatttgaagtcaggtaatgtaatgcctgcagctttgttctttttggttgtgattgctttgcatattcaggctctttattggttacatattaattttaaaatggttttttctaattctgggaagaatgtcattggtaatttgacaggagtagcattgaatctataaattgctctgggcattatggccattttaacaagatggattcatctatacatgagcatataatgtgttcccatttgtttttgtcatctctgatttccttgagaagtgttttgtaattctcattgtagagatcttttacctccctggttagctgtattcctaggtattttattcttttttgtggctgttgtgaataagatcatgttctagatttgactgtcagcttggatgttattgatgtatagaaatgctattgatttttgtacattgattttgtatcatgaaactctgctgaagttgtttatcagatctaggagcttttgggcaaagtctatggggttttctaggtatagaatcatattgtctgcaaacagagatagttggacttatgctcttcctatttgggtgtcttttctttctttctcattcctgattgctctagctgggacttccagtactatgttgaatagaagtggtgaggctggacatccttgtcttgttctgcttctcaaggggaattcttccagcttttgcattttcagtacgatgttggctgtgggtttgtcataagtggctcttattattttaaaatatgttttcacagtgtctggtttgttgtttttttaaaatgttgaattttattgaaagccttttctgaatctattgagatgatcatgtagttttttagttctgcttatgtgataaataacatttattgatttgcctatgttgaaccaaacttgcatcccaggggtaaaacctactttatcatgatgaattagttttttgatgtgctgctgggtttggtttgccagtattttgttgacgatttttgcatctattttcttcaaggagagtggcctgaggttttccttttttgttgtgcctcttcctgtttgtttggtcagaatgatgcttgcctcgcagaatgagttagagacaagtcccttctcctcagcttttaggaaaagtttcagtaggaatggtgccagctctttaacacatctggtagaatttggctgtgaattcatctggtcctgggctttgtctggttgataggctttttattattgattcaatttcagaactcattcttggtctgttcaggtattcagtttctttctggttcattcttaggagattgtacatttccagaaatgtatccatttcttctaggttttatagtatgtgtgcatagaggtattcatagtagtctctgaggttttttttaatatttctgtggggtcagtggtaacgtcccctttgccatttctggttgtgtttatttagatcttcttttttttctttattagtctagctagcagtctgtcaatcttatttgttctttcaaaaaaacctcctggatttatcttttgtatggttttcccatcttaatttcatttagtttagctctgattttgtttttttcttgtcttctgctagctttggggttggctggctcttgtttttcttgttcctctagttgagatgttaggttgttaatttgagacctttctaaagttttgatgtgggcatttagcactatgaatatttttcttaagttggaactgctttagctgtattccagagattctggtatggtatatctttgttctcgttagttcaaagaaaattttcaaagaattttttaccttgattttgttgtttaacaaaagtcattcattcaggagcaggttgtttaacttccatgtaattgtatggttttatgtaatcttcttagtattgattcttatttgattgcactggggtatgagagtgtggttggtaacatatatttttttgaatttgatgatgatattttaatgtcaattttgtggttgattttagagtgccatgtgtagatgagaaaaatgtatatactgttgtttttgggtggagtgttctgtaggtctctattatgcccatttggtcaagtgtctagctcaggtcccaaacatatttgttagttttctgcctcaacgatctgtctaatactgtcagtggcatgttgaagtctcctactattgttgtatggtaatctaagtctcttttaggtctctaagaacttgttttatgaatctgggtgcttctatgttgggtgcatatatattcaggttaggtcttcttgttgaattcaacccttagccattatataatgcccttctttgtattttttgattgttgttggtttaaagtctactttgtctgaaattaatatcaactcctgatttgttttccatttgcttggtagatttttctacatccctttactttgagactatgggtgtcactgcatgtgagatgggtctcttgaagatagcatatagttgggttttacttctttatccaacttgccgctctgtgccttttaattggaacatttagcctgtttacattcaattttgatatgtgtagatttaatcctggctttgtgtcactagctagttgttatgcagacttgattgtatagtggctttatagtgtcaatattctacacatttgtgtgttcctgtggtggcccataatggtctttcctttccatatttagcattcccttaaggacctcttataaggcaggtctggaagtaacaaattcccttagcatttacttgtctaaaaagattcttatgtttcctttgcttatgaagcttagtttggcaggatatcaaattcttggttagaatttcctgtctttaagaatgctgaatataggcccccaatctcttctgggctagggttcttgctgacagagccactgttagcctgatggggttctctttgtaggtgacctgccccttctctctagcttactttaacatttgtttctttcatttcaaccttggagaatcagatgactatttgtcttggggatggtcatcttgtatagtatctcacagaggttctctgtatttctcaaatttgaatgttggcctaacaaggttggagaaattttcatgaaccatatcttcaagtatattttccaagttccttgccttctcgctctctctttcagggatgccagtaagtagcagattttatttctttacgtaattctatatcccttggtggttttgttcatttttttctttatttttgtctaagttattttggaaaagcagtgttcgagctctgcaattctttcctcagcttggtcaattctgctgttaatacttgcaattgtattataaaattctcgaagtcatttttcagctctatcagatcaatttgattatttcttaaaatattcattttgtctttcagctcctgaatcattttgttatattccttagattccttggattgggtctcaactttctcctgtatctcaatgatctttattcttatccatattctgaatttaatgtctgtcatttcggccatttcagcctggttaaaaaccactgctggagaaccagtgcagttgtttggagctaagaagacatcttggctttttgatttgccagagttcttatcctggttctttcttatctgtatgggctgatgttcctttttatatttgatgttactgtcctttggatggatttcattgcttttttttccctttgatgcctgtgggtgtttgattgcggtataaagtgggttcagtcaactggcttcatttctggaatattttagggggcaaaggctcagcttagtatttctgggctgtatgctctaactctgggggcctggtacccagcccccagctttgttctctggtcccttgaggttagaaagctgctgtacaagaggggctgaggtattccctagccacaatactccaatagggggtgccagccaaagtgttttgttggggcagtggccatgggatctgtgctcactcacacatgccagcaactgcagcagcatcatggggtacacgtgttggctaaagaaaggtaccagtgggagtagggtgtcagtgttcctgcatgtacttgcactggcagtggtggtggtgtggcagggatggggtactagtctgaattttttaatttaaaggactctcagtctggagctgagattgcgccactgcactctagtctgggtgacagagtgagactccatctcaaaagaaaacattaggtacaccatggtaattttaataatgatgacaatgttgttgttgatgatagcagcagctaacatttattgattcctcattagaaatcattaggaacagattcaccctctcattttgtcctcacaacaatcttacaaagctaagttataaagttagtataagataatgttaccaagagtttaaaataaagtggagaaatggaaaaagcaagacagaaaattttatcttttataagggaaaacaacttactgaaaaacctggaaagaaatacagtatagtactaatagctgctggttctcaaaggtaaaactatgtgtagtttttcctttcatcttttctgtcttatttttctcttataagcccttgttacaaggggaaaatacaagaaaatgtatttaaaataaacagacgatgtgcaatttcatttctggagatgactaggcaatgttttttctcaaaggatcttttggggcctcgagaaaacctaggttagattttgctattcatcaggtaaaaatgtatttcctaccattctctgttggaggcaccatagcagaattcagcaaaagagaaacatggttatagattgctcagagatagaaagatgtctctgatgagtgataatgtaaagaaataagtcacctcaggtgtcatgatgatttatgcttttctcagtaaatttaattttatctttttttccccatttgtgccttacaagagccctgagagactaggacaccaggcattatcaatgcccatgttacagaaaatgaggggcagtgagcatagttacctgccaaggccacacaatgagctagtaaaaacctgaacacagaacacaatcttaactcttaactcagtgctttcttccatgacaacagcttatctgggagccctgattcctcttggcaggaaagacaagcctatcaatatatcagctatctaagatatttatggatgaagattctgtgtaatgtctgctgtaaattcagtttactacaactctcagcaaaatcaaaggaataccagttgtatcccaccttttactctgccattcatgcaacactcattgattgcatgcagagaactatgaaagtgttaggcattcagtgatgcttgtcttcgggtagcttatagtggggaagcagttaatcaaatctagaagtataacacaatggaatcagtaacgtgaaggagacataatgaagtgtcgtggctctcagaagagggacacgctgctcatcattcattgactcattcattcaacaaataaaaactgccttcttgttgccatgctttgtgttgaattccggggatgcacagttaatacagacacatgatatttatcctcaaggattatcatctagtgggaaacttaagattgaccaaatgattatacagacgtacattaaatcagaagtgataaatatggcaaaggatagttagtggtgtaagaagcatgtgatctagggtgagtttcttctgattcaagggtgagtttctttacagccctctactagaacatgagaaattttgtatttcctccaaggcttggctattcaaaggagagtttgcaggtgctgattggaagtggcttacttaatattgcttatatcctttattgtaataatctgataggctatttcttaccacactgccgcttccttttcctccttcacagccctgcatatagtagatggtaatcttcctgttctcagtttatatatggagtgtaatgttggactgttcctctttgcccaatgagccaggcaaacactaatggagagaaaactgcaatcatatccacagtgttcatagtaaaacattagatcccaacctgaagcatcctctgctgagggtagcagatggcatcagggtgcctatgttagaagtaatgcaaacctgattatactctttctaattttttcccctcctacatgaagcatgctgtagccacctcacagaatatggtgatgtgtcaaaacttaattagccaacacttgtaccccatctacattatgtcaaaaactacactttcaagaacaagagaagagagctccaaaatattctggcaggcagagaattcttagaacacaaagaaagagaataaggtagtaagctattttctattatcaaggccttaattctttcttggataatcagaaatgggagaaaattttctgggttccctggatgtaccagggttgccatatcttctatacaaaaatggaaaaatctatgacctgacatgtatgtgggaaacgtatggtctggtgtgcatgtatgtgggactagaagcaggcatgtttgaagtaaatacagtttctgtttatctggtatgcatcacagggtgaccaacccaccctgtttgctcaggatggaggggctttctaggatgcaagaatttcagtgttaaaactgagaaagccccaggcaatctgagataacccttgatgtatgtaatgtatggctcttaaaaaaaaaaaactcttattatattcttagaaggtcatgttgaccagtacagtgctgtcgcctttgttctctcctttgaccaatgtggaggaatgaggctgcctgcttacaggaatatcagagatctttctaattcctaaactggctcatctatccaaacccctcacccctctcccaccatttttcttttcctcaggcccagctccttgcctcttaatggtcatgctcacagctttggggctgaatactcaattagccactgcagcgcaagaagagtcccccagcttcatccatcctttatccatgaagaaggcccagagctccttttatatttgctagggatttttcaccagagtatagaaaaaaagtcacgtgatacacttttaagtcataaaaaggacaaaaaactcacaataaaaatatgcatttggaaatcttatatgcataaggagcaagttctagctcagtttgtttatatattaagttcatgcccaagagggtcaatgccttctctaatctatccctaagcccctttacctctattatttgcaggcttggtgagggagcctctatcctacgctgcttctgcttctcatgcctatcggaggcaatgcatgtaatacaaaccctatggaattgggacctctccagcttgttcagagctggttgaagctccttgctctgccactttttagttcagtatacttagatgaattatttaatcctctaaatctcagttcacttgttacattttcacagagacctagaaacattaaaaaatactatttacatgttcccaacctcctaaggtggctgcttcgtttgctctcacattcagcacgatagataattgtaaggcatacaagaatttcaaccatcaaaggtgtaagtaaattctctatattctcttcatgatgacaaaataagcagttgaatatttgccctaagattggaaatcaaaaagtttatccatcagtgctccataaattgcagttgacgcttccctgtggcactaagacagctgtcaaggtggaaaatggggcttaggcttggagataggagtctttgcgcaaaaggtttgcactgcctcaggtggagttaattctccctgacctcataggcccattgtaaagattaattgagaagtgatctaaaagtgtatgacacacagagtaagctcttgactgttggttaagttgggcacacttcttttctcctgttggcacaaggcatagaagtgccacatgctagtaagtggaatttctatcattttctggctctcctccttacctgcttagagtttatggcccatcatccctatcagtcctttttttttttttttttttttttttacaactctaccctttgctgctgtctttcatcaaacaaactcacctgtcattccttatagctggttggacctagctctctgccttctctgttcttatccccaggctatttaatgaatctggataaagatatacagttatcatttcatctgtaaccataaatctcaagtgtgtttcaccattctcccacattactctagtcaactcacgctcccacattcagggctagctattttattatctgccttccccatcacccaaatttccaattcccgctcctcactctcagttgatgaccttgattctcatttgagaatataaagcagggctactttatcctcccacaaccaaacctacttccccagctgtacccacacagaaaccctcctctgtccctccagttatgggggtaagctgtcccttcacctgctggtggccagcacctcctttcttggataggatcctacattatcttgcgtggaggaggacttgacacctacagagactctgtctttccttagcatcaccagtgaattggattattcccatcagtacaagtatatcctaatatgtcctggattaaaatatatccttattttgatccctatttctctctagctagcctacccccattttgtgctcccttttatgtcaaaaaatttttaaatagttttttatactgtcttcgctatctcattctatattcatttatcaaccttccaagcaggtttttccccccggtattccactgaaactgctcccatcaatgatttctgtcttgctaaatcaaatgatcagctaattgctctctccaggaaaaaactttgttcttcttttggcttttatggcaccacactttctggatgtccctcctttctcaccggatgtgccatctcggtctccattgctggtgccttccctgcctgccaatctctaaacgtcaggataccatagcactcaattcttagccctcttttctaactacattcactccctggatagtctaatgtatgcccatggctttaaatatttgttatatgccatggaccaacaaatttatatcttcagccccactttcttagtttccagacatgtattttgcctatttgacatttctatttgcatgtttaaaaggcacctcaaactcagtaactccagattagaattcctgatctcccatccctgccaaagtccactccttcctcagtcttctctatctcaatatatcaaagggccattcactcaatgactactctccttctctcacaaccaatgtccaatccatctgcatgtcctgcttgccctacgtttgaaacagatattgcactacatcacttatctgcaccttgcatcaaccatgtcttatgtctcttccagatgacacagtggtttcctagtgttttgtttccatccttaccttgtacagtcagcttcacacagcacacagcagttggagtgatctttcaataacctgtaccaagtctttccaatatctattgaaagctttctagtggttccctgtaacatcagcattaaaaccaaactcctttccatagcctatgtggctcttgacaatcagacttttgaccatttttctgtaacctgaattcgccctctgctcactgtcctctgttcatagtgaccttcttcctgtttatggaatgtgccaagtctgtaccacctgatggtctttgagcagctgttctctttggctcaataatcaacttcctgctgttcacttgcttactccacttaggttggctcaaatgttggccatttgaggaagaggaaggaagaggttggctcctcttccttcagtggggccttcccggctgccccatctaaaatagcaaccctggccttttttcattctgttttatttattaacttaccacattaaaaatattttacatatatatgtatatatgtgtgtatatatatctacgtactttattggtttaatatctgttcctgaccagatccctcttcgaggctgaaggacttattcccccaactgctgggagttctcagtggccatctctttcccaggattgtctttagctgataagagcccctgtgcaagatcgcacctcattcccagtgagcccacagtcaatgactgacctatacacctgtctaaagatgagggttccctcgccacaatgggggaccattttgaagggtcatcccagtttcagagctttccacgaggtcagcttcagcctttgttgagcctgcttcacggtccattccttctttcttccttttccccgcaggacttaagcccaagagccctttccaatgaacttcctgtgcacaatgtccatgtcagaggatgtttcctggggaacctgatctgtaaaaccttcatgaaaacataaggttcaccagtgcttagacctcatctgtctaattttcagttatcttcccagagcctaaaacagtgcctggcacatagcaggtgttcaataaatagtgagtaaatgaatgaataaagtagaagggctgggatcagacccagtcctgtgtgatctcaaaggcactgtgttctctgacccacaaacactaccatccaggcaattccaacttacaattagaaattcagttccatttgaaattctgcccttgcttctgcatgcacctggtaccagatgaaacttgcagttagttaaggcacacagattaattgaaagaactcattcccacaaatggtgaccctgggagagctcatgcatggcagtgtaattactttggtcatattgacacatcaggagagcccagagtcaggctcagcctgaggtttccatctgaactttgcatttccgtaggcctctctcccttgaagtcaaatgacataattttaacaaattttgagtgtgtgaataatttcttcttttcttctgccctggtatgtatactgatattaaagactagaatatttatcatgttggcagttcctgcctgctagatttgattttgttaagaagccgagttttcctctgacagcattcaactccacatcttcttattcttgacttccactttagacactttggtattagctagctctacaccaaaataaaatgggagggagccaataggaatagctaagtatactgaccacattcattcctgactactggggaaacacaaatccagttactaaataaaaagccagttcagataaggaatgatgctatatcttccaaatgactcctgtcgcattcactggattaaaacccagagcgtcaccacttatattccagtgatgtatttagtaccctactttaccaaatcactaggaaagccatggactgtaacatctgtccaaatgcagagagaatcaaactctgattatgctaatctgatatcgacacaaagacattagtaaaataggccactctcactgaataaaatgtccttggctttcataactgattttttgacgtcatctggttttctgcaaaagccagagatagagctgcttacatttcagggaagactgtacctccagtgaaaacatgctccagcgcacatgatatttcaaagcagccgtgctatctttccatagccactataaatgtgcaggcacttcctcgtcacaggtgagatagaaggtgaaaggtgtactgagatatctctttcctagcctctgttaaagacaaaaaaactcattttttccagctaaagcaataccaaagatgactggatgtcatccctggttctgtagaattacactgaagggggagctcagagttctttggaactggaggtcaggcttgcagaattagtcactatttatctgaagaccgagaatccagcttgttaccatgatttcaaggaactgaaagccacacaagtcaggtgaaattcagaggtaaatgctacaaatttgaaaaggggaagctcagtgtcctctgctcttttttcgagctattttgagacatgggaagacactaaagaaacatggcaagtattagaaataaaaagcaatcctttataagaacaaaattacagtgttgagatgaaacggaacctgtcaatttccaatcatctattcagaggacaaagaccccatttcagggaatcttctacagatgttcttttgatagctttttatttaatagtcaactggaggctcagctttttataatttagtttcccagaaaaagcatcctattctcttagatcatttagtacctctgagatttgcagtattcactcttccgcaatatttgcatctcatcgatgttaactgcagaaagtaacaagaatgtcgagaaagactcctttcttcaacagcctgcctgccatcccataaccaccttctctattttcactgcactggctcttttaaactactgcaagttcttccactctgtaattggaaaaatttttcgcttcaattttaaaaattatagacatgtaataaaatgttgccctgcactgcttgcttaatctatctgctcctcctcttatcgtcatcgtttcttttcacatcctggtgactgaagctgtttaaaccagatgcaccatgagaagcagggtaataggaatgaataacagaaggggaggctcatgtccttttgtgggttcatcctggaaggtggggggaggagaggcttagagaggggcatggtgagagggcagcattagagacaatgtactcaatcccccttgatcctgcccttaagctctttcagaaaacttaatctccaaagatttagtttaattttgattataaacaaaatatccttctaccaatggtaactgataacaacgaaagagcagggaaacacaccagctgatgtccctcttctgaatcagctgttcctgatggtgcacagcttcacttaattgttttgttcttccttctaccctgcctcattccacaagagttgttatggcttacaggataagaaaaacatattgtatctaacattacgtttaacaacaaaaacaacaacaaaaatcgaagcagattaaagacaaattcagatagaatggcaggatctagagtaattcaccagtttataaagttcctctaactttattacaagtgaaaatttggttctgaaggccttgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaaaatggaagtctagttggtctataattaggcactaatcatctgatatgatggagatacctctgcagaatctgtagaattttgaattatctacttgtcattttctggggaacatcatagaagtgataatgaaatcactcaaatttctggatattcttcaacctagcttggccatcctagtccaaaaaaatataataagcatttatcaagcaccgacaaacaatttcagtgcatattaattgggcacctactatgtgccaaataatttgcagcctcagagataagcaaacagaccattagacatggttaaatgtatgacaaattataattacatgagcaattactttagtaattcatgtaaattactacacttcatgaagactaacaagtacagatatcacattctataaagcccacaaatctagcacctatttcaccatgttatatgtagcaccgttacctcttttgtggactaagtagtatagcaaacttgatggaataaataacaccgacttcaaatcacaagggtattacatgagtagcctctactgacataatttcaagggtcagctatttctctgtaaaattaaaattaaattctgaaaacactatgtgctaggcacagtaatgggagcattccaataagctgtaatccttaccaccattttaaaatattagctccagtctacaagtcaggaaggaggctcaaggaggtaaagtaacttgcttagggacccctggagtccaagtgcattccttgttttcatgcatcctgccaacttcatagtttatttactgtgctccatatggtgcagtcactaccaagcaaatggcaatgaaaaagaaaaaaagaaaaaaacttgcctgccatttctcttcttcatagctagtgaaagagtttactaacatcagtgtcaatgatcataaagctaaaacgtcctaagccttaaatttgcttttcaaataccagtatttcagaggcagattacctgactccaataatatgcctcaaaccttgcactgtgtgtgcaatgaaagggaatattttcatccattataagaggctgtcagaggaaaacattttcctgatatcatacccaagagaacagcatgtgaagcaacactatcatattctaccgaactttcatatactccatgcagtacaatgtatattttatcttttgaaaagccttggtaacaaaaggataaaatatccatctaaaactcaaagtacattctaataatgctgcattcacattaatagcattcaaagaatctcatagccttctgcaggcagttcacttgtctgtgctaagaatctatccttcagttacaggaggaaaagctcaacccagtggctttgcccactctttatagctggggaagaggcagaagctaaggggcagtgtggaaggcatccattaactaagtcttcctcctgaatggcaggctagtgggaggaatttctttcccgtgcacagggagttaagtcggagctgaatttgcatatctctttagaatcacaagggtattgattctagcctctaagacatttacataaaggtttcaggacactctcaggaaatagcaaaggaaactttggaactgagagtgagaatccccagaaaagcaggggggaggaaatgcaccaatttttggcagttgaagaactgaaggcagggtgagtctaaagacatatatgcctaggagagacatctttgtgttggtgactcagtctctgagtctcacctggtgcagttcactcaaatggtatcctagcaagtcttcagggatcctgttttaaattgtttgtctgagatttttgtgaaatttgggaaagccatgccatcttctgggaaactcgaaagaagactaaagtcccttcaaggtcagacctttcaggcttgggaacaatttatttgctttggagaaataccactgtcatgatgggagtagctgtgtcatgtttcagcagtgcttgcaagagtggagtgttagagaagtccgaatgaccgcacctccccaagcaccagcctccaaggaaacatatgtctcccaggactgtgcagaagggatgaccctgggaggctggggtaagctggcagcaacagtgtttggtggggatgctgagccaaataccattgcaatcaaagcctttgatcatcctcttgttggtgtgacttgggaactgagggtcacccttgaattcctttcagtcttaacactgaactaggagaagcacaaatcttaaatttccatctattaccattattattatccacagagaactgagggcagcctgagaaatgaatggcagagatgtgtcagctttgcccctgttaaattatgcacatcatatgaaatgacttaaaggatgactgcctaggagaaacagagacaggccatttacactggccagtcctttgaggctcatgactttaaaagttattcctgatccactctgagccctgaggaacttggaaatgtgcctattacggtttccaaagtgcaatcatgcttttggggtgaacaccccagctgcaaaaacagtaaggtctgtcctcatttcacagtaagagacagagccaggaagagaggctgcagaggagacagagagagcaccattgccattttttacagagaaaaagcatacatatcgtgacctagaaattaaaactatgtgttttcccctgactctatggctgccagaactgcttcagtgatgacaactatcttgggcattttatgtgccatttttttgatggaacgtgtaaaaaaattaactacccattcagaaatgaaattcactatgtgatttgccaccttgccagggaagagagcaatggtcagataacaaaacagacatgtaacaccactcctaaggataaaatacgtatagtgctagagccaaaacaaacaggctgcagagatgcaattaataggctgaaatatggtggtatcagagcacccaccatccctcatgctctcaaaacatggcaaagagaaggaaattggctgaaggtcagggctcttctgacccatgctgccttcttcctaagcccttgatatagatggaatgtatttctcccctgtcttcagtttcagtgcaatgttctgtaaaggaaaccagttttggagtcagacaacctaagattgaaactcagctctgtttcttgtcatctctgtaactctgggtaaattatttaacaactgcacatttcagtttcctggtttgtaaaactggccatctgaggtcatttggggaactaaatgagataaaatatgtatgtataaatggcagtagtaagtactcaatatatttagttcctttcccttttttcatctatatgtaattccaggatctggggtattttagaattcatctatttattatttcattcaataaacatttattgactgctttctgtatattacatactttgctgctaaccagatgctgacacagccataaaaattagtgggccaaaaggaacccagactgtagattgaaaggggtcatctttatgcacatcttatgcctcatatctgttgatgtctcaagcatcctacagggatgttacaccatccacgtaggaaataccagatctcacggtaatcggcaaggacaatttgttcgtcaaaacagattttgttgctcccacttgaatgcctcctttagaagtctctgttattaattcacctctgaaaggtgatcaacaaactcttacattcttccctttggttaatagattgattccgatctattaaaagtcaaattaaagttctcaccaagtgtgtaatcctgggagtttgtgtaacattcagctttcccatgtcttcacaattcttttaattttatatttctaatcacagaggccaacaacacagaacagtttgactatattaataaaattacttatttatatattatctgtgaccacttcctttcccccattacattcctccaagtggataacttacagttattaactttcaggaggcccctatatatcatagcatcataccattaagccttttggaaattcatcacaaatcagtatacagatgacattgatgtcttattgctattcattcctcccgggccgtttttagcagttcattttttatatccctgcagtgcagaaatatggctcactccagtatctgtcctttttgtaatcgcaaaaggaaagcttggcagttgtcatatattacactcttgaggaaaatgctagtaatacgtcgaattgattgaacagcatggacccaaactgcttggcatagggctatttcctcactgctattaagattttggttaaaaaaaaaaaaaccttaccttttagattcagaaactgtgaatcattaaaaggcaatttgtagaataaagatcacatacttgaagaagcctaaaagctcccctctatttcctctctttagattttgaacgtatttccagcatgcattcacattgttgcatgctacgctgctggaaacagtgtcattggccagaagctggttgccacctgggttgtgaaatagcccaggacttcccaggctctggaggggtagaagcttaaactggtaaagaagttgagaacattgtgactgcaaaggcattaggcaaaagccatacctatatgccatccttatcattgcaaaggtgccactagaaggactatggtcttggaggaggcaagcaaagaaagaagattgatatggtttggctttgtccccacccaaatctcacctggaattgtagctcccacaattcccatgtgtcatgagacggatctggtgggaggtaattgaatcacgggaatgggtctttcccatggtattcttgtgagagtaagtttcatgagatctgatggttttataaaagggagtttccctgcacaaattctcttgtctgctgccgtgtgagacatgcctttgaccttccaccatgattgtgaggcctccccagccatgtggaactgtaggtccattgaacctcttttcccttataaattacccagccttgggtatatctttatcagcagtatgaaagcagactaatacaaagttgtattaaaagaggaattaagatgaaagtaagaaaagtcatagctccatataatcaagcctatgctctcccctgcccctcatctttggaatgaggtagtgccaactgggcctgggggacctgaaatacagggcacaggcagttccgttggaatcattcttcaggaggccaaaccatggccaccggagtcctttccgatatgaatatttgtaactaatctgaggctttctttccaacaccagctacaatagttggtgatccacctgggtttactttttaaggccactagacatgtcccccagtttctattaattttgactgcaatcaactcacctttcttctgggaattgcccttgacctctaagaacagtggtgtgctgtgtgctgataaatctctatcatccagctctccagataaaaaagggggcttatatgtagcatttgcagatttctgtggtgttaacacccctaccatggtggatttcaagtcaccaccttgatggcacccaatgtggaggtgggaatagatacacatgatgggctctgaaaggcaggataagccagctccttaaggataccactgtacaggagacaccttgcctgggaataccagggaagagatgtgcctttcagaaggtactgaaggctgcctccctagaccctaggagtgcatggcaggatgagagcactttggtgttattcacgcttaggaggtccctgtgtatgttaagctgttcttgcattgttatacagaaatagccaaggctgggtaatttataacgaaaagaggtttaagtggcttacagttctgtaggctatataagcatggcactggcatctgcttagcttctggggaagcctcggggagtttttactcatggcagaaaaagtgtcagcagacaagtcacatggcaaaagcaggaacaagagccagtaaggaagaagatgccacacatttttaaacaactggacctagtgagaactcactcacgagtacagcaccaagaggatggcactcaaccattcatgggaaatccacccccatggtccaattacctcctgccaggccctaccttcaatattggggattataattcaacatgagatttggagggcacaatatcccaactatattactgtgggatcaggctatggttggactccagttaaactatcatctttgctgaacttctccccaggcctacttcccccattccctggcagctttcacgtgagaaacttcttcagaaaattatttgcataagaattctcatctcaagctctaaacctatgcttagacagcatcagactctggaagggtgacacaacacttattttgaacagataattttgtgaaactcttattctatttgaatttgacaagctcagaataaatgacgtgagagtcaacaaacactgaattgatttctgtattcaaacctacctagcaacgatgcattaaatagcaacatactaagtataatgtgtattcattttctccatcatagtgcaagtaatgcattttgcttatactgagaatagtgaaaatagctacttggcttaaaaggaagcaagagtggcttttccttaacttaaaaaaaatagtttctgaatatttcagaggaaaatgcaaattgagaaaaatctctgctccttagatgagatgtgaaaaatattcttgataggaaggtggcagaaaatatttttaggcagatgagatgctgctagtttgataggtttctattagatataacgtaccaaactgtgtgcgtgtatacattttcacccactggtaaaaatgaaatcatgtaccttcatcttatgatattgtatgtaaatgtttcatgtgggttagagcatgcatgtttcagagctaagggccagaatggactaacatcctatcaagtgttacatctgatgaagatctgagtaaaaacacaacactaatctgttcagaacatcaggtgggcaaagataacattaacaaaataaaactctcgccttactgaatagacactgggtttgctctatgagaaaaacagatattaggctgaatggcttattttcacattatttgcagtttggattttggccctagcatactacagagcaaggaactaaaacatctaactttttaaaacgttaagaatatgagatactggaaagagatggattattttagttattcttaatctttcgtgcaacattaataaagttgtatctatatgacattaaatcttcatcagaaaaattaagtctgggagctgctcagatgttcaactgcctacgctgcatagactcctcaaattgcattatttattccagtttttcagttttaatttggttcttttgtttcagaaaccaagcttagaagaaaatgagcattttcttaagtccttcaaaaagaatctactatatttcttttcttttctgaggtagtagatatattattatttatttttattttaattttccaaccaaagatacctggtttataggcaataatatccctttaataggattcaaagtgtctgaggtttacatagaacaactttgtgggtttattcaaatggtcaggcttacaaggagtagatcgaccaatttcagagccttcttggagagaatgtacaactgataccagctttttaagatcagcatcaaaagcttatcttgggtgtgtgtgactgtttctgccgctgtccaggagatctaccagtcttacctttttaactaatgtaaaaccatttgtctcaggctgcttgacaggtggagctagtctgtaaaacttagctcatgtttttttcttttctctcccatgtttagatggatggtaagagagctgagctgcaagcagtattatgtgaataacacattttgttgcctatgtttaagaggctggttgttttgtaaaatgcctgttagttgttctctttgtttgattgttcgtttgtttttgagatggagtctcactttgtcgcccaggttggagtgcagtggcacgatctctgctcactgcaacctccacctccctggttcaagcaattctcctgcctcagcctcccgagtagctgggactacaggtgcgcaccaccacacctggctaatttttgtaattttttagtagagacggggtttcaccatattggccaggctggtcttgaactcctgaccccatgatctgcctgccttggcctgctaaagtgctgggattacaggcgtgagccactgctcctggccaaatgcctgttagttttatctgtgggattatgtaaccagaaaactaaagtggtatgatgtgatggctactgaactcatgagattcctggaaaacattctctcttgtaggaattcatctgcctataaattaattaaacatctcaagctagtccttctataatttttaataaaaattatactcagttctgggataacttgaattttctctcatttaagtaccgtcactaaaattgtacaactgtcaatctttctgtgtttagttaaaatgttccatgaaagtggagaaccaatttcactcatacagaaaagagaaggcacatgttccttggtcatatgtatacagaaccaggagaaaagaggaagtgaaaggacagggaaagaaggacagggaaagagacacagggaaatgatgaaagggagggaggaggttggagataaagactggagagaaaagaaaaggctaagagagtaaaagagatgaaaaaatgagaaaaaatgagaagaagtatagagaaataaaggaacatgatgcaggaaagaagagtaaagtcctttctaatacccacaggaggagtaaagaatgagagagaattagagacacttatgaaatactaaagccaacaaccaggtgtttccttgggagatttgcctaatgactctgcattgattttctggatgatgtcaagaggtaaacattacaaagaactgccaagacagtgagcggcaatcctcagccaagatctaaactcagcaatggtgcatgagaacctgatacccacaacagaatgcttctgcactgaatccatttcccaacttaaaatacagcatcttagactttcacattttgcttatctttcatcacttttcactgctatgcactgaaatcttccgctccctgcaaaaagctctgctctgagtataaacacaactaccttgatctcattttaaaatctgtaatcaaaatcctcttttataacattcattttgctctgaatccttcattccagctactcagagtacaatataccaaaggagagagcctgtatccaaaactttgaggaataattttgatagtggttaataagaggacaatgcaagtttcttccaatgttagtgctttaaagggtgttttcctttaggaggatttacatcctagttaaatcttcattccaggatggctgcaagcaaatatattccacacgtcccatctaaccactgctcatacagaatcaaagtacatcaaggttggaaggggattcacaggtcaagtcaaagctctcatctgatgcctcattgtgttctacaatttcaagtacccctcagtgcccatcagaactctttctgtgccacgggtctccatgaaacagaaggtcattcaattttcacatagcttgaattcttattttgaattgaagtctggccaaagttactttcaaacagcagagctagttctcccctatgtctgagcctgcacagaaaaggtacatttaaaatcagctgtaatgacttcttaaaatattttcctttccaatagatgcatagacagagaaaactgaatataaaacattttgatttttcattactttcttcctcttcttctgtactttactgtgtcaatgtgttttctattagttaaccttactgtcagcactaggggaactgatgctaacattccagatactgtcttctcagtgaagggtattgcatgacaatggcctcacttgtcatggatgtagaacctcaggtactgtgtaattagactgaattcatctcttggcatttcccctgtgctatttactcaactgagcatattattcattaacttcctgtactttttcacatgtagtgttcttacagaatatgttgctcggcctgaatctgtgacattttatgtaaatatagtttgagaggaaagttttatctttatgccttttgggtttggggtactagcgaggtggctctgaattcttcttctgtcttccatagagttgaaatcacttcacctctctctacatatgctatgaattctaatgcaaacattagtttctctgacaaagaaattcaactgggagttatgttttcttgctgaaaacaaaaacacctgtgatggtagctaacagcatgttcttctctgccagtcattggcttgataacttgcattattacctgcctactaagtgcattttttcatataattctctccaccaccaccctgcaaggaaggtagaatgatgatgctccttttacaaatgaggaaactgaagcttagagaagttaagccaaataaaccctttgtttagtaatcaaagataatcttggttcattttgaatcaaccagcaccttctcacatttatctacgatagtgctggctagacagtagcaatctaaaattcaaactcagttctcacatctggtcatccatggccatgtattctctcccaaatggaggtatacattgtcttgcttatcctgctttcctctaaccacaactttttaaagtgctcctcattttctggaaacttcaacttgtcctgggcttgattctctgtgaaaccattgacaaatgatttctcctctggtcctccttggctctaagccctttctcctgcatctctacatgccatttaacaatattatttctcataaaattccccgtgctgccacttcgatatctttagctcctgccagttcctttttcggtactatcgtttgtgattctatcaccataatcttatttttaagagcttcccaatccactagagccatcttccatgaagcaatgagatcacatcaattttaatcatgatattttaaaaatctgccttttgaagttttcatatccatgtctgacaatgcctagctttttttctttttttaaccttgctaccattatttctaagataacacacctactttttcctagagttactgtccactccacatcactaagcctttccttgttggttagaattaaataaccagacccctatcactttctcctggaaaggatataattgatatgtcaataaaggaatttgtctaaccacaaaatacagatgagtaagaattgcatccacttcttcagcagctcttaaagatctgctgtatcccacaaacatacataaaattatacataccattttcatatcagagtttcagtgtaaaaagacctttggtgcttaaagacagctattgagttttaaatgggtaaggatacttatccaggaaaatttaacatcagttatccaataaaaaccagcaccacggcaacacatttagatgacaaaattgatcgacctttttgttttctttccaccttctgcatatagagtaagatcatctgacatttaagatcctcctgcaagttacatttctttctatctcccttttcatgctagctcatatcctacctcttccataaagtcttgtttgacaaacccaacttctcactctattaaaacattaatgccaagatgattgatttgctaattaatcatttcttaatatctataccgctattatctcaaatagttatttaaatcagttactgccatttagcttctgtgtgtctatattttctccccaaatatatcgtaaattttttgaaggaacataaaagcctcaaacataagaggtttcagaacatagcaatgtggacatgccgtgaatggcaatgattaaattttgcaatcaggttcagaggaaaattttaaaatagagaagtgataagattttaaataccaaaccaattcacatttcttattttttcaacttattttaatagtcataaaaaacataactgaaaattagttttagtaacagattctgtggatagcaaagttcttttccccatgggccttctcacattccccccaccttggatcgtagcaacttttggtgaattccacctaaacgcatttcttggtaagcaagggtactcttggttccattcaaatcagtcagcgctgtcatggataaccccaaggatataaaatgaaaatatgaaagcatgtttatcataaggagctcttaatctaagggctaatatctatagtatatttgtcttactattccttacaaggaaagcgatattaatattacaggccaaggttcagatcctaaaataaatataagtaaggtgcttaagaagccaaataaagagagatttcacagttagctaaagagatcaagaggaatttaagagatagtattggagccacagaggttaaaagcaggggttcggactccttaggcaagtggggtgaagggtatattgtggccaaagcacagatcccaggaaaaggagagatgcattcactttgtttgttttgtttgtttgttttttaaagtttacactctcactgggaacaaaaggtatgtacgaagtataatgcaaatgtctgtggaaaggagatttggtgctgtattacaagggctgtgaatgccaggctgaagcatttatacctgatttataagcaattaagagttttattagctcgtatttatttcatgggaaatgtggaaacttccatgtagatacacctatagctttgtgttggatgtcttccgatcgtccatttggatccatctttaccttgcttaggggcttggaggctggcttgcatggactgattcaacaagctcctttggcttctgccttctttccataagaggggaggaaaggagtgcagtcagagccttgttccccagctccacccttaggggttgccctgagctggttgcttccctcactgaaggtcaggtgttcctctccatggttggttcatttggtctccaggttctggtcctcactccctctcctcaccccttccagacctggggtggttataaacggtccctctatgagggatcctcatgactcaacatgttccatgtctcttgctgagactctccctgatataatccccaggtatccagaaatcaaaaggaaattggcgacaacagtagttttagcctttgctgggcaaaatttcaaacaaaaaacctgaagatatggggaaaaatcagcttctttgagataaccaatgtaggtcttcagtctgctgatggccagcttcttctcttttttgcttctctctctttctctgtctctctttttaaagatggggtcttattatgttgctcaggctggtcttgaactcctggcttcaagtgatcctcttgctttaagccttctggggagctgggattgcaggtgcaagccactgcaccctgcttctttttacttcttatattcctgactgtgccattaggctaaggtcaattatttctacaacctatctccttctcagaggtttcaagatcttctaccctctgtatcaggaacaggttgtattccaaaaacttgtactggatgtctgtgaaagtctgccaattcattagggaaatgtaaatcaaaatcacagtgagagatcacttcacaaccattaggatggctatttcaaaataaataacaaaaaaaaaaaaacaacaagtttctgtgaggatatggaaagattggaatccttgtgtgttgctgatgagaatgtaaaatagtatagccactgtgtaaaaaagtgtgacaaacctcaaaaagttaaacatagatatgccccagtaattccactccttgccatacacccagaaaaactggaagcagggactcaaacagttcattgtataccaattttcattgcagccttattcacaataatcaaaagctggatgcaacccaaatgtctatcgacagaagaacagacaaacaaaatgtggtatatacatacaatggagtattattcagccttaaaaatgaattaaattttgatacatgctccaacatggatggaccttgaaaacattatgctcagtgaaataagccagacataaaaaagataaatattatgtaattctacttatatgaggtacctagagcaggcaaattcatagaaacagaacgtaggacagaggttaccaggggctgagggggatggaaaatggggagttcttgtttactgggtacagagtttcaagttgggatgataaaaaagttacaaaaatgcatagttgtgatgactgcacaatagcctgaatgtactcaatgtcactgaaccatccactttaaaatggttaaagaaaaaatggctgtcaaatattctgcagcagagaccaaacacaggacccatatgaagaactatcggtagttaagaactcctagaaatgacaagatgatactgagagtggagaggaacttagaccccacagcattggactggaagtgtcaggagctggcttccaaaggtgctctcacaaatctaagctgctatgaatctgtgattagattcatttttattgtttccctgttgtacaggaaaaaggctgtttctgactataattttacaaaaatgccaaaaagttttaaaaataatttgttgatttgtggttagtaaaccagtataatctttatgttcacatctattattttagattccttttggcactgcaacaaattaccccataattagtggctcaagtgaactcaaatttattatcttatatttggggagttagaaatctgaaatcagttttgctgggctaaaattaaagtgtcagtagggctgtattccttctggaagctccaaggaagaatctgtttctttgcgctttgcagcttccagaggcctccttggctcatggccctgtgtcactccgacctctgcttccatcctcacgtctctgttctgattcggactctcctgcttctgtcttttccttttaaggactctatggttacaaggggtttgcctggatagtccagggtaaccttccagttttaaaatcctatatttaatcatatcttcaagataccttctgctatgtaaagtgacacatttagaagtcctgtggattaagatgtggacatttttggaaggggacattattctgtctaccacatttatcaactccaaatatattttcaaatgaaatggaaagagaggttagaacatacgtatttttcagattaccaaattaatgcaagtctgttttagcaaatctagaaactttagaaaagaaaaaataaaacagtattatccttcatcccagtctcttttttagatcctaccttctatacttaacatatgataaggatttgtcgtgtcatcaactaccttttatacttagatcctacttcttatacttaacatatgatcctaccttttatacttaatatatgataattatgtttagatcctaccttttatacctaacatatgacagatcctactttttatacttaacatatgataagcaattgtcatgtccttaactactgaggtgtctattttattaaatgagttaaaagatgagaaaagatgacggaactgagttttggttaaaatgatagaatcggcaagtgggttttagtctcagttttaatatgttttttctccttttagatattttagatcagcagataggtttctatgtgccatatttccttcctgaaagctaaactcacgacctttcaatacccacctatatcaaatcctcaaagcaaatatctatattccaaaataattgattgaagttatccatattttactctgcggtaaccttctcatcctgtatttcattttcaaattaccaagaatctcacttatgtgactatacactaaaattaaaacacaaacacactgcgtacactcactttggtctgagcaaaaagacatgaaaggtgaacatttttgtgaaattttacaagttcaatggctaacaagggtctcaatctttaaaacagtcagtgaggcttaactcagtgtaaaacatcatttatatcataatcaaacttcttcatatatggaaactttaagcaacctgaaaccacaaagaattatctccccaacctcctctttttgattaagttaatttagtagctttaactagaatggattaattagctccaaacaatgtagcaattggatgttaaatttaacagggtcaaagggtggagattggttccaaggtaggagtcttatatctacatacaacccagccttaagggcgtgccatttgtaaaaatacaattacagatttaatattcattatgcaaaatgtttgggatcataagtgcttcaaattttactaattttggatacttgcatatatctaatgagatttattggggatgggatccaagtcgaaacaaaaaattcatgtatgtttcatatacattatgtcttatgtagatagcctgaaggtaattatatacaatattttaaataactttttgcatgaaacacagtttgaactgcattttgactgcaacctgtcacatgaggctaaaaggtgaaataaatctcatttttaaataaaaatgaatattttctattacactcaaggcacagtgcataggatgagaaggaataactattattccttgctattcttgtactgaggttgaattttagccttaaactatggtaaggaaagcccttgttccttcatttgagcccaatgtcaggtcaaatatgttaaaataaacatagtaacgcaagtcaggggcttccagagagctgcatcacagttttgtgcataagatacacttgaacaccagaaagaataatgcttgtggataaaaatgcgacacaaaacatgtagttactaggctgcatttcacgtactgacacccagcttggctcagacttcaaaatgtgacatcttgcccaaattcaacaaaacttcccagtcttacagggtgattttcaaatcgattaagttgggtatttctttaagggaaaacaaaaatcagagcagtgatttgaattctcactttcaaaacaagtttccaactcattaaacatcaccttcaaaatgtgatacaaacatgatttacctattgcctagcaaattaaggcatttcattaccaattagtttatcacgaccaactatattttattttctacctttcacaaatgcaaaaggaaccatcagacagttctcagctcttcaaaccactgacaacaaaaattgtgccagatataaatatttacatcatgaaaagtaaatgttgccaagattccaaactccaatgcatttgaaaattggtttggatcaggtatactttcctgaattggaaagatacaaaatcatctgttcaaaaaatatctctaaaacaaaaaaaaacccaagtcataacatgtgagtgatttttaacactagactatctcccaatctcttctttcccaataaattttagggagaagctgtgttgacatttttttctttcacatcaacatttttcctttaagacattctgatggaaagtaaaaattatatatccattgtttgtgttagtttgacacattttccatctcaatcccaatctgtactttatctaaaaccccttcaaatgcttgccataactcgtaggcgaaggattcagctcccgaacactgcctcaggacctgccctctgctgtcctctctagcctaccatcttgcaagcctctcttcgctccctgtgttcagccttgctggctacctttcagctgcattctggaactcaggcaccaaaccccattctgtatcttgggcttttccaccccctgcttttccttttgcctagaatgcaattatcccctacatcaccctctccaagaaagaaagaatgactgaatatttaatcataactacaacttttccttcttaaatactgaccagcgaactcacacgtgttcacgactttaaataaataattcacctttttaaagagaaatgtacttagaagccatgacaagctccttgcagaatttataaaaataaaactataaatggaacaataattaggatagcatcgttttatatggaatcagagcaataaactaaatgacctatatatgacctttccacaaaaatgcttctcaagtcatatttaaaacagtacacaaatactgcataactaaatggtgtcgaccacatgcaatgtcttttaaaacctgctttgtgacctgagtcaaagtcacttacagctttttgatgagtcattaggggtgtgtgtatctgtgacagttacatggtacaagaaaatatatttcaatacatcagaaggggaaaaagttaacttacaaacttcatggtatttatggtgaacagactgcacaaaggaagagagaacagagcccaatgacccaaaccctgaagaatcagccgctggtattatcaaaagttgtcaataattttaacctcaattttttgcacacaaattattttccatttctcttaacaatagctaaattacctttgaacacaattttctgcatgtgcattttttttttacctttaacaacctactcaacagtaaaagatagccaagtagacatgaaccagcaagagaagtgctaagattccagtgatgagaagacccaatgggcacttgtgcccttccacaaattaaagaggagctcgttatggggggaggagagtgaaggagggatttaggtgtgagaatcacaaagcccagctcagcatttctgtgcaggagctaggattcttagcaagcaagatgcccctaggaagattaattattgattttcttataaatcatctaaggtgatttttgtctgtttttttcctcccaagatgatgaacgtctgattttatttttgttaattggttttctcacttcactgaggttaaaagaaggcctagtaaagcagtttcttagaggaaagattttcccagcatgataggcaggggtggccactatgctttctgtcctttatgggggtaccaaggttgtctgataagacttcaggcaacctccaggaggtacagagtaatcagaagcacaaaagtttgactagttagggagaaaaagcacaatttagacatatttctatctaatggcggcaggtctgaagtctgtggtattcctaggtgggaggacaaactcatcacagagactgaagccttgaggattagctttcagaatcaagatggccccatcttcaactttaccatggaagcaatatggtggcttaccttcctgccccccgtgttgatgcgaagaggtgtcagaaaggggtcgaagatcatgtgactggtctctatgttgactggcgactgccgtttccccacagagcaaagattccaagctgagttcaccaatccccagaaagaaggaactagaaacaaaaagaaattatagaattaggctgagtagcaggttggggaaacaacataaataaacagagctatgtacaaacgtggtaaaatggaagagaaccaccaaatgttcccacccatggagatccttgggggttgctatggtattttcctggtctgaatcttggtccacttctctaagtcttacctgcatggtctcttgtcatcagattttcttgtttgaggcccactcatcctgcagtttctttgttgactgcagtcatcattaacactttaatgctaacatcattgttcaggtctcatcatctttgcaatatgcctggggtagcacaaatatttagcaattccctggagttgatgctgtgcttttcctatctggcaagaacgatgtgaaaatcaaccttatcctatttggaagtttttcaaggaaagtgtcattcagtgtacacaaagtttttctttgggttgtcaagactaaactgagggagtgacttattttatgagccccctaatcaatgccagacaagagcttagcaacttgacttcatctttgtttagttcaacactgtgtcattaacctaatgtacttgtagataaagaattggtgttcatttgataggcagaaaaatgacattaagagctgagcacaaatacccaaaggaaaccgtccactcattttcagtgtcacatgaaaacttctattagaatgtatttctgtggcaatttccagttcgatttctctctatttaagaaagttttcagggcaagggtggggagccaacctactaattttatatcagtgaagatcaaaactatactttcagcctttccctgcccctttcagtacttccatcgagtctctggatccatgtgtccttcagattcccctgagattatatggccattcattcatccacccatagtacatgcagtgaactcctatttggcatcacgcactgggttaggctgaatctcgaggaaggcaggtaagcacaagaacaactaacacactggggaggctcactagtgtgaggtcgagtatgttatgagactccggatgaggggaagccaatcctgccatggtagaggggaggcagggagtgactcctggagaagatgagcctaacaatcacattagccttcttaaatggacctgtcctctcagaaactcaagtttaattaaacttaaattgaataaaggctttaacttacagtagccatcattcttgcctatagcatagatggagaaaactaaggcaaaagaggagtttggagacacttgccaaagatactcaaattctttgactctcttatttgttataggcaactgtaacagacatgggaggagaactaaaaataagttccttggcctagacaaacacttcaacatcaaaataagatgggtctcattttaaaatatgacaaatatctaatttggtttcatccatgccaataagcctctggtagaccatttcctttagtttaaggagtttgaattggctttttagtcattaatgactttcaaaatggtagcaatggcctgagttacagagggagaaagaggaggaggaggaagaggagaaacattgacacatgtgcatgggcttcctcggccctctcatttcttatcatttcttaaaatatgttatcactacaagttactccacctttagaaggtaccacgtcctagcaagactacaatatttaagaaagttcttgcattatgaatgcacttatattataaatataaacttgtcttttctaaactacttttttttaaaaaaaacactgacttgatcttatatttatttatccctcaatcatctcaaattatgaaaataaagccttcattagggcatcctcctagcagtctttgtccgtaacgcacacacaagtggcaaatgtgagcatgccagggatatagtcatggcacctccacaagtgaactgagtggcccttggtaagtcatgtgtcccttggaccttcttcatggttcctgtggtaggccgaatggctctccaccaatgatgtttactatcctaatcctcagaacatgtgaatatgctatcttagatggtaaagggtattttgcagatgtaattaagttaatcgttttgggatggagagattatctaggattatctgggtgggcccaatgtaatcacagaagtctttataagagaaatgtaggagggtcagagatataaagatatacagatggaaacagaggtcagccaggagagaagataatactctgctggctttgaagatggaggaaggggacatgaaccaaggaatgcaggtggcctctagaagctggaagaggcaagacaatggattctccacctagagcttcctgctgtaaggaatataggcctgctgataccatgatgtttaaccccttgagaatatatttgacctccagaaacgtaggataataaatttctgctgttttaagccatgcagttgtgatcatttgttatggcagtaacggaaaagtaatacagcacccctttacctttaaaactctgtgagacaataacctctttgacaatgaagacatctatgatgcttgcagggctctccctagaaggcagctgcatgattaaagtagttacagctggtgcacattgcatttcatctactcccatgaaaagcattaacaaaaataattccaagcccataaatggattataagactgctattatgtggcaacatgggtgggcagctgctgctgtacttcactaataaacgtcatgcccaaaaagtacccccgcaaaaacacaaacaggaaaaactttatgcgaacatctgccttctcttttattgggcatggaattctttatgacgaacagtttcggggttttatatccccacttcacgatcaaagcctgcgtctctgatgctaatcacctgctcagccaatcgaggaagaagtgagaaacctctctcctgctcagctgtgtccctcattggctccagccctgaactgctatctaagtttatttacccctggatggctgattttaaatcagctatgaattaatagcttttcagaaatagaagccaccttagagatcgtctgacttaaattcattacatggatttaaggccatagaggcagggagtaaagtcctccactctaggtcacacagccaggtagaggcgaggaaggacagagtaaagaacattactcaagatttccagtgctactgagcctctgctgctctaaaccccttcctctccagcaggctctatacatgagcagatcattttaggaaatttcagttaattgctgccaagacccctgtaagacttttgctatcatttctcttttggtaaatcaagaataacattagtgccaattttccagttaaaataaatttcaagtgcaaaggtttgaatcaaactgctttgaaagtcaactattctaaataaacttaggattttaaaggagccatacaaccatggagtaacatacatagaagggcctgggtgtgaaaagacttcagttcaggcgatgtgtttgggtcccatctgcaggcctctgaggagacctgatggggatgattgcacacaaagagctgctccagggatagttcctggggtcagctgcaccgggcaaggttttagtgcagataaaaatgagaagtcagtgctgttaggagcggtgttaagtgttgggacaataattaagatattgaagctagtctagggaactcaagtgccgaatggaccagactaggtctgcaaatgtggtgtaatctagattctagggaaatggtttaggacgaaggctgtgaaaacaggcgtccatgaagtgcctgtgcctactggggcatgggagtcagatggcccactttacatgcagagcaaggatgggcgtatgaatgaaagcttcaagatttagagtgagaaacttgccctgtgggtttgtgcagaactgtcagttatatccaaggttctgatacttaactacccttcatctacccttcatagtgttatctttcaggtttatagacacccgtgtcaccttttggagcaaaagtgggttatataatgctgtggcaggcactgcctctatttccaaggtaagagaaatattgttgaatttttttctcttagtttccatggctatcctccaaaatcagatgtttaaacttttatttttaaagcatccattattatggcttattagctaatgctgtgtctttacttgatcaatacaacttactgttgagagaaaatgtaaataaagcaaaatagagtaagaatcactctaattaatggacaaccagtctgacgatgtttgaattccatcatccttggcatcctttttgtacaatcttctaatttacatataaactagaacacaaaacagacccaaatatttttgcaaattaattttcacacagcctaaaccatggaacttaactgctgcatcacagcgatgtgttatcttgccaaagtatttcccaatggcactactgccattcttaccataaattacaaatcccaaacgttctcttggctctgggtccagtgagttttgaaagatgctcagtgactctgtgatttcaactgcttaaatcatgagccttggcaaacccaaagcaaaacttatcagctgcttgttcagacccatgaaataaaaaagctccagctgtttaataacacaccttggcaacgtctggacaaaaacaacaaagttttcaccaaaaacaaataggtcagaagagcaaggaaccagaggaatcaagtccgataaggagagttaaaactggccttgacttctttgtcctagagaaggtgttccgaagttagattgtgcttttaggcatcttccttattcatttgtcctaagccagcagaatttgctgctgtgggcaggatattaggcacttggaataagtttatacagcttatgtgaatttgctaagtcctatggcaacaagataaattcaattcaaaagcatttactgacagcctctgatgtgccaggcattagggttggcactgaaagttgatgcaacaaatctttactgaggacctactatgtgtcaggcactgccatcagttctgggaagtcaattatgaatgagagatatggttcctattctcatgaatcttgcaggctagtgggaaatatgggagataaacaagtttctatatgtctatctgtgtaaagtttttggtaagcatgttgtagagacaagacggtaatggatcatagcttaaagcatgtatgggagagaaaacctaggtagcatggtcaagggtggtctctctggaagggtcagctggtagactctggaaggactgggaaagttgcttctaaacagtggcaggagaaaggatgtccaaggcagagcgaaagtgagcagtcttggcagagaagagctggatgtgttcaggaacagagaggaagtcagtcgacttgagcctgatggaccagatgaggagaagagcgaaatgagatgggggctggctgggtagaccaggaacagatggctcagtgctctgcaggccacactaaggagtttgcattttactccaagttaatagaaagccactgagagtttagcagggaaataccatggtctgattttttaattaaaggcaggtatctgcctcagatggaacacagccaagagcaagctcgactatccttgaagtagtttgaatgggaaaagaattggttcccaagcaacagttggggacataggtttttaagtgaatttaatcctattgcttttggtgtgtttaaattctatttcaaaggcagaactaattgaatgttttaaaattattctcttcaaaatatgtgccaataaaatcgtgttttcctaggaactagtgctttacaagccattctttgaagcaaggaatattttcatgaagacactcagctaaagcaatcttttctcgttttcaagcaataaactaagtcccctactttttggtcaagggaaagcaaatgaaagttgggaaaatgaacgctggcataaaacatatctctagtgaattcaatcctacagataaagccttccacttcaatatagcaatctctactttggggttataaagcatatgaatacattttaaataagaactcatatctttcccttgctcttttcctcaccaatcctgatttactgtctcttcctctcttctcaactgtaataaatctccactttgagccattattaatgagcaagtttaaaatacccactgctgcaggcttttggtctgtttctgatttgatttatttcatagatggaattggccttaaagttaacccctttgctgatgatttcttcctccattgcagggcctctgactcatagcacatggagggtctttaactagggctgcccattgttaaaggtaagttctcccattgagaactagggctgtcacttgggaacctctaaggaattgcatatatcctatttaacccataatcattaatttgtgcattcatctaaaaaattaatggactgtatctgatgaaccagggatagaaagataaatcaaaatgctcccactcttcaggacactcagtatggtgggaagatagacaagctaacaaatagttataacaaaatatgatagatgttataataagggtatgtgtatattaaggcttaaattaattcagagcaagaagcaagctgacctggcccttttctcaagtgctaaggtaagccttactcatagagagtgcattattttaatcctattgctttaggtgtgtttttagtcttgtaactagttaaaacattgaatcatctcctcaaacagagatatactagtcctaacaactaagatggattatcaccggaatgccaactattatacagggaaaatttaagccactgcatcttccatcttctcacttctccaatatttctcccatacagctattattccatggggaaaagatcattagtaccatgtccttaccacagaaccatcagaaggtggctaaattactaggtggcttcatttctctagctgtaaaaatgggggtgacagctacttcacagagctgttgggaagattgtgagaatgtatttataaatggtctagcataatgttggctctataataaggatttaaaacattggagaaggggttgagtgaggagggggaacagcatgaaccacagtgtgattccaacactgtagcattctcagggcagaaacagtcgagggtgaaggatccaggcagaagggtacagggaggcaactttcagatgcccacccaacccagcctggtttcagaacagggcactctgatgggagtctaggtcaagggattaattgcttaattccatactttcaatgagccatgtgcatttatttcttggatccataggtctcaatgtctggataaatgaaggcagtgagcagtgatatgggtcatccaatagggtttttaactccaaagaaaaatcattttaatgtagcttttgggagttgtcagattacttatttgtgcagcagcagcttcgtccttcttcctgtttgtacttggttccaagtggtgactggctggatccccaaaagcacatcactaaaggtaaagagaaaggaggaagagggaattctcttttgctgatcaccccctgtttaacaagctctgtgctaggaacttgacacatcttatcttgctcaatcctcctcattattattattttacaggtgaggaaaataatactcaaagaggttaaatgactttctaaggtcacctggccagtaggttagggaactagaatttgagatcagtttctttctttaaaacaaacaaagaaaaaaaccaaaggaagtaatgtatgtatggtaacaggtcaaatgatccacaggtgtataaagcaagaggtaatcatctcttcctccttccagtaacatcctgaggaaaccagtgtgaaagtgtattaggcatcattcaacatctttcagtatactcctacaaacatacatacaaatatatacacatgtatatatatatttgagaggttcttttctaaaaaagaagtatttttataaaaagtaacattatgccatggatgtccctccatgtccatactaatagagcttctctttcttgtgtaaagctacagaacttctacagtttgaatgcacttcacttttctcaatcattccctagatgaaagacattacagttatttccatcttactttaccatgaaaatcaatgctgcaataaatagcctcagagatattctttttcatactggtgctttcatttcagtagaaaagattcctaaaggtagtattgttcagtcaaggtaggcacatgctttattttaatagatgctgtcaaattagtttcaaagatactggtagtgactatgatgaacatttactctcctatcggcaatgtgtgatgcatccatttccccaaaatctccatagtattggatgttatttattatttatttttagcaatctacaggaagaaatggtatctcactgattgaatttgcattttctagctactagaaatatttctagtatattctcatatgctcattgattatttgcatttctcttctgatcgtattcttcacatatttttctctgggttatttatgtttttcatttcaacttcagctgtcatgtgaattatggagatattaaccttttgtgacatggtataaatattttcttatagcctcttatctagcttttaaaccttgtttttgatattttgctatataaggattttaccattttgtatggttggatttgttgataattttctttataaggtttctgggttttctctctcatttaagatggcctttccaactacaggttatatacgtgtttttcttacatttttataaaatatttttattgttatactttttacaacttgattatttaaaaatataccagtgattaatatttgtatatgctatgagacaggggtctaatattttttccctgataaaaagtgaataatgccagcattatttattaaacaaaccatctttcaccatcaaactgaacgcccctttgatcacagattaagtttccatatgtattggatttgcttctggtctttctagattgtttcacctatttgtgtattcttgtgtaagtgtcatactgttttgagtgtagtaacatttatggtaatttatacgacaaaacttccttcctgatcaaaaagatgctgctcttcccctgctaccactacgggaccgtaaacacccaagctccacggaaatctggagttaggactagtgatcctaggaacccttaagctgttggaccattcttgggggcacaagactgtcagaggttatctggctcctcctcatgtcttcaggtagttaggtacttcagtcatacttgatagaggacagtgtctgcccctttcctcaaaaagccctcaaggggaaatttgctcttttaatcaccttggaagtagactttattatcgccctgattctcaccagtcttaatggaatctgagacatagagacgtcaaactaacttgttcaagataaacaaaaaaaaaaaaaacaccctggcaagtggtgaggtcaaaattcaaaactcaggttgttctggctccagattccttgtgttcttataactcctgtgctatacttcctccctaacctggtgccctgacttaagccaaacatgttttcttctgagcctcagtctcctcctttgtaaaatcagggtcataagaggacacactttgctgaatatctttgtccaccaaagtgatagtgaaaaatcaaaacaataaaattagcaatgatcatcatagccaattctttttattcaccaagtcatggagtatgccattggtgggaaatcagaaagaaggtagatttacatcaaattctacataattgcagtccccaaagatgggtactagttttcccattttacagataggaaactgaggctcaaagagttgagtaatttatccaaggttattcagccagtgcacagctgagctggtgatttgaacccaggtctaaaattcccactcttattctgctctcattcatccctcagacctagcacagaattaagatgaattaagctgccattatggtttcctcctcaatattttgctttctgagaattaagcctcctgaatcaggtgactcattcttgcgagaatccacaggaaggcataaaagacagtctggttgacgtaggcattaagctcttgtgtgcctgtatcaggtttaagatttagtctaacagttgtattaagcattatcaggttacatttggctagcaatttttcttgccccatgtaattacaggtgcttcagataaaatctgaaattagttgatagaaactgggaattaaaaccacaaagagaggaatgtctcaatgcatgtcaataaaccagcccattaattatttctacctactcaactctgaagaaaacgaccaggctgatgcctctggataatcacatgacctacttgatgtttatacaaaagctgaatcttcttggctttcagaagcaaataccagtaatgttgaaaccagcagggacacaagaattaaatgccagaaaaaaataatatgaccactgaaaataggtgatcttcttcagcctttgtaaattctgaaagttcaccaaaacagtatcaggtgatgatttcccacaaattcaaacatctggtgaagcacttctaaaatcctgcaaaacatctggatatcatggaatacatatgtatgtatgtatatgtttagtatgtaaacatctcactgtccctctatccctttaacactcactctctctgtacgtacatgcaaaattatacccttacacacatggcaaaagtaggtgaataatgaagggtacagtagaattgcaaaccctaccacatattaataactgtatatggagatcagttgaacttagccttacagcccattgcagcagtggatacctcagtttttgcaatttctcattgtcttcacatttgtgtaattctatagaaacctccagctgttccagtctgtcttgaggtttatgtgtatgtagggtattttctttattatttacacaaataacagggcttagttatcttcatgagacatcaggagaaataatcttcatgctgccactgagtcttggaacccaaacacaacacaactggtcaccaaagatggaacgaaaccacatatataatccgttggtgttttaatgattttgcactaggattcattgtccaataaatgtgcaatgtattttttatcgaggtgctagattttgcttctatgatatagtgtcttgaccaacacatttcacttgtcctcttaactttcctgttagacttttgtataattacacttcctattagccaggaaggaaatcttgcaggcattatatatatatatatatctgtcatctcccaaatcttaccatgatcaaatctgggtgatagctttgaatgctttgaatattgaacctagctactagtagcctaatgcaggttcccactgccaggtgccttagtttttactacagtatcttactaaagttcccttttacaaatgacatgagagcttggcagacaaggaagaaccaggactaaaaattgggctaggtccatggtccacaacagaatttagtgcacagcaatgtaaggatgatgttactctagacctgtgttcccttgcagccctggagttctgatttgatgctaccaccatgttgccagtttccattccaatacttgacacaatgtagatactcaacaactacttattgagtgggtggatggatgcatggatggatgcatgagagagggcaggaccaagtgtctgctttgcataccattttctctcccgtccttgtcatactatgatcttacaatataatttgtagaatgagtggagaattattctacttcatttcaatacccccaataacacaatatgctcatgcttacttttgtgcttttgctttaattattctttccactttctacaccccatagtcaaattctatacctcttagcacccctaatttaaatactaatccctccattaagtcatcctttactattgaaatcatcactctggatttctagagaagctggttaggtgctagaggattcctacttaattatgcatggctatattgttcattgtcttaaaaatgcatttcctaaatagatgcaagttcttcaagatcaggaactctgatatggcacaagacctaattacagggcctgggcctataaaaggtgactgaccaaaagtaaatatctctaaagggtttttaaagaaaatctcttgtattcaaaatgactctagcaggaaaatagatttagtgaatttctggcactcctcaacaccttgtacccaaatgtatgcccagcctttcggggctcctggcagttccaccaacaagcctttgcctgcagtggctgcactgcctggagcatccttccttactttcctatgcatggagtgcttgttgcaagcatgatctgggactcaaaccagagactctgattaaataagtctatggcgggatccagagatttgcattatttaacaagcagcccagctacttcccatgcaattgtccataggtcatgataataggagaaaccagctgatgaaattaacatttattggaagaaagcaggtttttctcagctttacaaggtcagcaacatgaccttaacaatgacaggcctaaagggaaaaacacatcgactaaagggtcaataagaaagtatggaacagagaaacaaacattcaaatgttgcctcctgccctgccccttgagagagttacagaacagtatctcctggtggggttagtaaaatttcactgggacccaccattgctctcaattttctccaccttttgttctaattcttcgtccaccaaacaacctttggatagaggttaccaagtgttctaatcccaagaaagaaaaagaatgtcttagatggcagacatgaatagttctgttatagaaaggggatttcccaattcccacattttaaaatgaacggtcataatggcttattcaccatcctgtgctattttaatgatcaccagtcaggcctaaggtccaaatcagtgaatataccaggactatcctgtttctggaattaagaatatgtttatcagacatggggccatgaagttttaaccggtatgtggcctccaacaggcactgccagcaaccagaccctgcccctcaatggcctacctctgcaggctaccctcaccttatgggaagagagtctgcaacttatcatcacgtaagaaacaataagctgcatttaaaaaccaaaaatgatttgtgcacaaagacattaacaagaacataatttatcataatgaaacactgaaaacaatctaaatgtgcaacaataataggggaacggtttagtaaattaggtatactcacataaagaatattggtgccatcattaacataaattttaacaatacagcaaatttttatatatagtctcaaatatataaaacaatgtgcactggagggacaaaaaaataaccaaaatgtggatagatgttatctctggatagtgaaattacaggtgaatattaacatacatgtatattccaagctatttacaatgaggaggtagtactttcagagttaaaacatttgaaaaataagactgcttatttgggccagattttaacactacagagaattatattctgttaaactgattaattttcttatcacatctcttttcattagcaaggaaatgataaagagactctacttctctgcacccactttccgaatttctgggtcaactgggatgatccgggtagacccaggaataacatgcaggtggtacaccctccccttgtaggaaaggagagaaagggcagtcacacttagcagttgtcagaaagaagacctgggagacttctctatatcaagcaagaattcctccttttcatccctgcccttggacaagagaagctaatagggatttagttaattggctggttttcatcctaattggctgatgaatccattccaatctcaagaaaaattgcagaggaagaaacaaatgagggctcagctgccaattgatgttttagagacggcattttatgtgtcatgaggtctgaggtcctggagctcagagtattagctttccgggagactggggctccatcaagggtggggtaaatatccttgctgggagaccacaggctttcctgtctcattgaagaaaaaccgaaaacgatggcacacattcgattttgtcatctaatgctaaattcagattaaatcaacacggactcgttctggggtagggacagaaaactccagggggctgaggctcttgcattatgtgggccttctgaaggtgccaggtaagccgatgtcagctgagtttgctcctacttttcccacatcagtcagttctaccacttaacagggggattagtaatctcatttcttgggactgtcatcaaagtatcagaataaaaccacttagtagagctagccttctgcaaaatgttgaggtgggctaaattggtcttccacaccttgtcacctgccttttaagcctccttcccctcgactcccttatcaggtaggctatttccatttctcactccctttcagtctagctctcctgctccccatgcaagattacacctctcacagtcacacagtctgaactgctcattggtacttacgatcagatataaacaaaaacacacttaggaaaggtgggaatgatgatagaaatttgtgctagctaagaaattcaggccagatgagggctatgaccaaaccatcctaaaaagatcacaggaaatcttgtcatttgggacaacatggatgaacctggggggcggcttattaactaagccaggccccgaaaacaaatactgcattatctcacttacacgtggattctaaaatagttgaactcacagaagcagagaacagaatggtagttaccagggctgggacaagaggagcaattggggagatgttagtcaaaggatataaaatttcagttaagtggaataagttccagaaatctattttattaacatggtaattacagttaaaaacaatgcattgtctacttggaaagtgctaagaacagattttaagtgttttcaccacaaaaaaataagtgtgtgaggtaagacgtatgttaattaacttgatttagtttaactacttcaatctactgatcagatgcttgtagtatctctggggattaagaacactcaatggctcctcattgccactggtgcactgaacctcctttagtctggctttgactgccctttgctgtctggcagcaatccatcccgtgggacctgttttctgtggctcctcatcttggcctctggctggatgagagtctgacatttccagtgtgtcctggtgctttcctttctccatcacaccatgtccctcacctggcatgcctactcattcaaatcttactcattttccaaggctggactcaagtattgcttcctttgaggattttcctcaatgctccttacattaagtgatactttcttcttcctctaaaattctgttttatccaatgtctctgccatttgtaacatgtcttataacaatagcagaaagcatgtttttgcgtcttaataatccttgtagcttatagtatgataatgaaatatacgttgtttgatgaatgaatgaggagtgaatttttaaggtatcctgggcataaattctgagtgaatgctaccacaccacacagctggacctttctcttattcttgtttacttgctctggctctcatatattcgcacatttctgtcagcacaattagggtatctaaattgaaaaataaaatattgataagcagagagaaaaacagtaaaaacaaaaatatgatgaatgcttccattgtctcagaaatgacagacctttttctacttggcctttataatgtaattatttaagtatttctgtatgtagaatccaccttgctctttagaggccctcaggcactttttacaatgcaacatcttgattttggaatgcatcttcatgtgcaaaaaaaaaaaaaaaaaaaaaaagccaaaaaccttgtctagactttgagtcacctttatttgtgtactgtaaaagaccggtaggagcagcccaaatggctacagtgaatgggagagcctcataaaatccgacaaaggttcacatacctgaggtttgtaaacacagcatatgttcttgtcagtgtagatgtgaccttgccggtctctttgcagactatattagtgctgtgcaaatatttctactcaattgtaaaggcacattatactcagggaaattattctcccagcaaacagacagatgtttagcttcactttaatatgacactataatctgaattcttaatgtgagacagaggtcctgttggagctagggtgaaactacacatgcaaagttttaacaatgcagcactttgtagcatagattaagtcactacctctttctgactaaaactttctgctctttctttcaagcccctcttgtagcaccatgtgcaggggccatggtgcacttagcacaccttgacaatcctgagatgatgcaggaggtggctgtgaggatatttatcagtctctctgagcactatcaaacacttctgcttgcaaagccctatagaataacatggagcaacatatgtccagttgtgaggttcccctcttaggagaatatgaaacatgcctatcctagagatatcagcaaggctcaaaaaattcaaggaaaaagaaaaagtagctggggatagaccaaacccacatatctagattcattcttgggggctttggcattcaacaaacagatccatcttcaacttgctagttgttgtcaaggttaattatcctttaggacttcaagtaaaggaggccaaggaaactgagctcaactcaagtttagacacagtgaaatttcttttactgctgggactcagcaacaagactgccacccctgtgaggttctctccattttcaatccacttttctacactccgcctgtattgctggggcaggggctcaataagccatatttctgctttgtcagctcattcctgcaggctctgcccataggaaatctagagagacactggaaggctggagctcttcctgtttgcctcctgttccggttggcattattccagcgatgggtcattgccctggcacttggttccactcttcagatttaccctcccatattcctagaacaagactcatcataaccccttggacacaccaacaccaaccagctgcaacgctccccagaggactgggttccagttctgcaagggcctcctccaagctccagagtcctcaacagcaggtggagaaagccctgctatgagtctccagttctgtgctctccgatgctcagcttctaaattcttttcccagtcccttctccttattctgccgtccctgaagtggtagttggttccttttattatgacttttttgtggtgcaccagggtcttttatgtgtgtgcctttccagccctctaatatccaattaaacaattattttatatgaaattatcacagttgagataattgcatggtttctattttcttcactgggccctaattgacataacttattacttgtaacagagttacacagatgtttgctaaattgctgatattatatatttttgaaggtatatttacatgctaaaaatgtatgattaatctgcatctattaaaaagaacatgatagatcactattactgtccagaaagatgtccataatatattgagtgataacagcagtgattttttattagtaagcatttgtttcatatataagaaaaataaataaaattatgaagaagttaaaaataacggatactatgatctctatgagaatactttgttattcctatttaaataactttgagaatatctttagcataagtaattggggcagcaggatttttcttctgcccaatatttagttgggattgcaataactatcaaacaattaagatgcaatttatgtctttgtcacaatttgaaacccaaaacatttatataatatgtgtaattcaaaggcacacatgctactgcatctaaaatttaactttttaactaaatataactaaaaccaactcacagaaaagtctacagctgggaagaagaattagtaaaaactttaattgtggtctcatttacacttctattttcaaactcattcatgaattaattttaactctgtgcctctgccttcaatcaagccataagtacctgtcagaaaatgacagtgtttgaatatctgcacatatgttggaaatttctacactttgattcctttgtcaaaatttccacttagagctgtgtgggtgaggctctaaggcacaggcaaggaggttagtctctcactgtggccaagattccacgccaaagaatgttcatttagcgtgtaagccaacgcagaactccttattaagacagttggccctcagagtcttataaagcaggaggggagtatgatgtatggaagcaaatgttgagcaggaactacagaaggttagccttaagggtgatgttccatagaggaaccttgggctaatcttaatctgtgaagatggacattggactatagagctttgtggcccctgtgcagcctgccattatacaagatcacttaactacaatgtcttaaagcaactcagtctaaggcagtagttgcaaaaattttggatagtatatccctgttggggaaaaaaatttgcgtgcaatgccaccatgtgaatatttattcataaattacatatggatgctgttatactaattattagtacaattaggaacaattagtattgggtaccctccaagacactgaatatcagccagcaccctctcattcagttgtagtcacactgaccttcttactgatcattagccttgctaaacatgccctgtctcaccatccctgcactggatgcctctctgtccactagccacttggttcatattctcacctacttcagggctgctcaaaggtcaatctcagaagggcttctctgacttcctgtgttacctctgaccctctgtctcctctttactctagaacacttgtgctgggttcctctgtttaccttgcagacactgctttccccttctctgtccttttctgtgccctgggaggctgatttgcatggattacattcaactgggctcccctgaattatggcttctctttgggtttggccaataggaggcactcgcagggaactggagggtgagaagagagatgcctggacgtttattccatcagcaaccacccttgcagggctatggatgggaaatggctgttttcctctcccaaggtcacacctcctattgggtgtccttctcctaccaccaatcactgcttcctcttcatttgggccaccgcttcttgccctggaggagatagttccctattattagaaggccctagacgacttcaccattccttgttagtttctcttaaactctgcctagctttctataaatagcttttcgtgcactctcctcagacatttactttgagcatgccatctgtttcttcccaagaccctgaatgatacagcacttatcaccaataaatatagcatatatttatattgatagtctgattcctcccatttgaatggaaaatagccgagcgcagagatttttcacctgttgttgttttctgctatgtgcttagctcctaggatagtgcacagcatttagtaggcacccaggtacctgccaaatacatagatgaataatattttcctcctaggtcccaatggattgtcttgcacattccattttggaaatcaccaacttaaggaacaaatatatattattcttcaccaggttttactaagtgttggactaacctagcttaattcctacataatacatatccctgattattttcaaagcacatgaaatgtaatgtagcaggaaactctcctgaaagttctcaggttcctcctccaagattctcataatgaaagctccaacagatattgagccaatcatgagaaggaccttattagttcaccttttcaagttgtctttaacagattttctttctccctcctgatttccgttttaagaacatttcttcttttctttcaataaggaccataaaaactgcccaaggaagcaaagccttggctcactcactttgtccctacttgcaacaggagaaaaatcatcaaaatcctgttccccggctcagttacttaatttgcatatgatgctccattacttaattatcttataactcttagggcttagttgcccaaatcagacttaacaatcatctttggtaacaacatcccttacagcaaagagctaactcaaaagaaaatgattttttaaaaaaatgacaaacacatacaaatacctttttgtcctccatgcaaaaatttgggtgatggattctttatgaattgctctatgcctattaaacatgcccattactttactattggaaaaaccagattatttttcacatgcctgagtttcctttctttgtactaatcaataactgcagatgtactctaagagttgctaccatactgaacaaaatctgatcttcaagacaacctcgtggaacctgctgaggttgccttgggagggagaacctaagtggtgagaaactgctgaatcctgtatccaggaggaaacattctgtacacacaataacttctatgtgcatgtggctacaatttttaatgctgtgctcatctctggctatatatagtggcatgagtaagagttttctcgtgtggttttgagtttcttgagctgtaaatcaaaacattgtgatgttcaaacagtctttgggaagaagagaaaattaactgccaaaattattaaaatggaactctactttctattagaaccagaatagaacagcttgcatgaataggtaagtgcaaagtaagatataattttctttcacttgaatggcgtttgtatttccctctgccagcagtggtatgactctccaatgttgtattactttgctaaagctgctataacaagtatcacacactgggtggtgaaacaacagaactttactgtctcacagttctggagagagttctcatttaacttgaataattatatttgcaacaaccctttttccaagtgaggttatattctgaggtaccgggggttaggactgcaacttgtacatttgggaaaggggatgtaactgcacactggctcatgctcagctatttgagaggctgaggtgggaagatcacttgagcccaggagttcaagcgttcaaggctgcaataagccagtatcatgccactgcattccagcctgggtgacagagagggaccctgtctcaaaaaaaaaaaattaaaactaaaagaagatcaataaatttgggggagcacaatttaaccacaacaaatggtaaaaataaaaaatgttaggtcttaagaaaatactaagaaacacttggtccagctcttttgttttttagtgataaatagaaagggaaaatgtcttatccagggttacctgtcagcaatagcaacatagactcagagcacgaggcacaaggctctgctctggtgctttccaaagcacacactgcctttatttcattcttcccaaagctgagactcacatgcatttgtggaggggaagtagcagcagtgactcatcctatatgaaaacccatccagagacttatgtgacatatctacagcaacttgctttgtggaggtcattcaaaataggagaattaaaaaaggactaggctggtcttgaactcctggcctcaagagatactcctgcctcagtctcctaaagtattagaattataggtgtgagtcactgcatgcagcctagattcaaagtcttatacaaactttcctcgtttaaatcactgtgtggtttgtctcctgattggactcagactgatgcagtctgttctagtaccagtttgtttttacattgaaatatttgctccatcaggagtttatcttggtataagctgtgagtatggatctagctttatttttcacagatggctatctggttgatccaaacatttattgaaaaacttttttcctaactcattttaaataccatctttattatatactcaattcccacatgtatttgggtttattccagactttaaattgtattccattacactctgtcttttccatctccactaccacattgtttgaatatctgtttaatatctgataggaatagtccctggatatttttgttttttttttttaatttgaactttgttatcagaatgtctagatttcctgctggaaattttattgggaattgcaatacgtttgtagattagggatatttgacatctgagtcttctcaagaactagccactttttattagttcaagtctcttttggtgtttctcaacagtattaaacattttttaattcacaaaaggagcactgtgtatatttatagtgtacaatatatttgatataaatataccaatagcattttaattcatataaatcttgcatattattacttttattcctaaatatttgatcattttggttattgtgatggcatcttttcttccattataactttttaacttgttgctcttagatatataaagggtacaaatatcaaacataaaaagggaaagcaaggtttcaaaactgaattacaaaacttcagtgccagacactgtacctggcaattgctcagtgctccaagaaagttaaaccaacaaataaaaccaattttaatagtgataagtattactctgttgtgattagagcttccaccataaagtattttcaagtccattatcatttgttttctgcaaactctgagagacaaacattattctcatttgacagaaaggaaaactgaggttcaaagataaatgactttttaaactaaagtgttacaatttgacagaaaggaaaactgaggttcaaagataagtgactttttaaactaaagtgttacaagccagtttgacaaagcttgtatgctattataatttcagattcaaattccaatgctccctctcctaaatttttattgttttgaggaaaattaaactaaacattaaaaaagttcatttacttccatttttatgcctcccttgaaatgcaaatttagcacaagccaaccatctctctctaagcatttccaagcacttgaggcatccacttctttgcactcagcagatggtcataaaatatgaacaaatgaagacagttcatctttagactctagggagtcacggagtcacataagcttaggatttgaatgggcttagaggatttctaaataatgctctctggtttataaataaaaaagctaaggcactacgtcctagagctagtaaaaaaaaccagatatcctcactcccaaaccagtgttctgatgcttgtaaaatctggcactggtttaatcagagagtgaccagctggaataaagtcctgatcagattgcttttattctgctttctctgaagccaagaaaggtcatcaaagatgcacaggagagactgcaaatgagtacaatactgtgcaacagtgatattcagaattattaaattggaagccctggtgccctttgcaggcacaaagcagctcctctgtaaggaaatgaaaagaggttgcgtgtcgagggatgaggcttctttctatagagaccccattacagctccagaggaaagaacatcagttccttccagggagtctgtgtaacagataatgtatgcttcttttcaggctgtcaagattcacaaaagagataggaagtttgaggctctattactggtgaccttcccacagaatacactgcatctcatttttaaaaatagcccggctcttgggtggagtatttgatggccttcataaaggaactgaaaactttgggagaagtactgaaaggaatagagtgaaaaagagaaagaagaaagcaagaggcaaaaaagaagagaaaaactggtttcctactgctccttcatctttctgcatctcgaagtggtcacctttttttatctcagagcctcattacctctgagaggtttcctgatggcctcaactcatctctaccatccttcagaatgctaaacaggttggactttgtcaccacccatagaaaccttggttatttccacattgtaaagtccgcattccttagcatagcaagccaggtgctttttggaaattcagcttccactccagcttcattttctgctccacttctccaggtaactcatgctttggccaccgtggcaacttgccactcctcaaacatgccactggctgcccactctcttgggcatgcttttacttttttcccctttctttcatcaatcaatattctccctaagaatcaagactcagatcagaggctcctgtttctgagaaaccttccagccaaaatgaatcactcccccacctaagctttttctctggtctcaaagccttctactctaagctctggttcttttgattagacctaaagacaaagccatttgtaaaccaataacagatctgataactttttggttctcacttataagtgggagttgaacaatgagaacacatggacagagggaggggaacctcacacaccggggcctatcagggggtagggggaaaggggagggagagcattaggacaaatacctaatgcatgcggggcttaaaacctagatgacggattgacggatgcagcaaaccaccatggcacgtgtatacctatgtaacaaacctgcacattctgcacatgtgtcccagaacttaaaataacaaaaaatctggactaattttagatttccaaaaatgttgcagagatagtatagacagttccccacctaataatttttagaagaaatattttatagaaaagcataaagaatgatattaaaaacacatgtatactcattttccatctttatcaaatctcaacattctgccatttgattcagatttttttttaaagatataaaacaatacttggttctccatgtaagtctccttgattctaaggagacttgattctaattcttcctactcagaattaagcactctcctgatttggcatttatggttaattggcctgcttttatatattcactacacatgtatgtatcccagaagttatatttgattgccttgtatgttgttgtacacatatgacctcattctatatatagatcagctgtacatattttgattttcactcaacaatacatttgtgatttttgcagatgtagttcacttattgaatgttctatatagtattttattgtgtggatacacaaaaataattgtcttcaacagatagaaattttagcttctcatttgttttttaatgtagagtaagagaaacatacaacagtgcacattgcagcactgcttgtattagcaaaaacaggaagtggatctggattgatccattaactatgaatcttacccatccttaaacatcatttaagcccttagggtagaaaagaaattatggggaaatcaaaatgatacatttggcagtggtgagaggcttcctgttccttttggttcagcaaaaaactttttattctttagacctacaaaaaagcagaggctttttttttgacccacacccaaagcagagggaaatcagtcagcatttttaagggaactacacatgctacaggggccctttagcgtctgccaagctcttcccagtctcaagaatggaggtaggagatgctgttcatgctattatacagaatggcagaattaagtccaaatggcacctggagtcttacctctttatatcctagttttctgtattcagtactggcccagattgcttttattttctgttgaaataataaactcttttacaaaaaatatgattgtttttcctcagttttaaaatatgcctataaatattctacaggaatagagggtaatagatgagctcaagtattttgcgagttaattaaagtagaacttggatttatttcgtaacgattttatacaaattgaaaggaaagtaagaaacgttattccaaggtgttcaaggcaggccttgtaccatctcacttcccactggttctactgaaacatttacatttatcactttttttccttctgtttattatgagagtatctaatttcataggcatggtggtagaacattggggtgaataagatgatgtctgctcttaagaagttacttgctactccctgaatatatgaaaactttttttttttttgtaaagagagagtgatggtatggttcactaaggaaggcaggagattgagtagttctggagagtcacataggaagcatgttccacatagagggtggatgcaagtgaaggccaagttgtaaccatctatcactgcctccaaggagcacctgcaatagcacatctacttggagtccaagtcctggttttcatagtttggccaattccatcactgcccaaaccatgaagtaagaaaaataatacaacttagttcaagagaataaaaacaaaatggagtgtgccacacaccagctatattcaactattttctgctctcctagagtgccatgcatttgcaagcctccaagcctttgcagatactcctgctttgaatgacattccctgtattctgtacttatccactgtgtaatgcaaccttaaagctaattttaagcattgtctttctaggaaacctttctcactccccccgagaggggtgaatcatccctcccttgtgtatattcccagagaaggctgtttctgcctctgtaaaatacagcactcagcacagtctgacaaatagtctcgtaaattgtgcatgcctctgtgtcctttactcttagaaggcagggactcatctaattcatctttgtcgtgccttcaatctgtggcacagtgctaacatatagtaagtgttcaatgtgaagttcattaaatgacgtatgtagctgcaaagaaaaaaacacgtagcattaggaattagagtagtcaacagatagtggtagtagaattgcctcaaattccatgtaagtatgattctactgaaaataactgagttttttttttttttttgataattggcattaattcccttggctctaccaagagatcttaggttcaattccctgggcaagcaagcaaattgtgtatgtttgagtgggtaagtgaggctattccacatgaatctcatttagaaattatgttcaaagcaggccatttgctactggattcattacctttcctagatagcacagggtgaaatgtttgcttttattaaagtaaataaatagctcataattgtgcctaggaagggaaacttaaaggcaagaagaaaaacactagacagggaatataaaagtgtattattttttcctcaatattgcggttcattatatttttgaaacagttgtgaatggcttttccttaagtaatatctgggctcttttctctagataatttacaggaaaagagaaatataccttagcaaggcaggctaaggaaaattattttaaaactcaaacatatcaggctaaaatattcatgatgtaaaaacaaagcaaacaaaacaaacagataagcaaaaacaaaacgagaagaaaacatgagaataccaatagaagaaaaatatgtaatttggtttggttccagctctggctgtgattaagcatataccatcctccattttccattgattacaaataaataaatataaggagtctatctgaaaattcagaaaagtaaataatgacaggtgaattggggaatgaaatgaaatggaaagtagtatcaatatggtattaagcttaaaggtattttcagttttcttcttaatcctccagcttggactctaggacagcccaaatcccagaactgcacatcaagcagagacaggaaatgcttcaagggaaacatatgtacctgtctgtattctagaaaagccccagtcacaaagccttagactagtgaaagcagcagctatgcatacacctcaaactctggaagacattctttttttttttttttttgagcagagaaactggaaaactaggttcctattgttctctctctcgctctctctctctgtgtgtgtgtgtgtgtgtgtgtgtgtgtgtgtgtgtgtgtgtgaatcgtcattaattttctctttccagtctctctctggttgttttgccctcaagggaagcaagtcatcatgggaagtgtgaaatagcatagggaacctaaagccctgccatttatgacagaagaccagagaaataagcccctggggactagagagtgaagagaaatcatggaggagaaagtggtagagaaaaagtacacctaattttgtgtatgaagtctcaggctcaccactaattggcgcatgcattgaaattaaccaaggcagcgtaacaactgctttgataattaaactatgatatagaacaaagctcaggttgacccctgggtggttggtatgtgtgtgtggagcagacaaactagctctacaaaggaattgaaaactaaactaacacagaagccagagtctaaatagagcaggttgaggttagacttatgacaagaaccatgggagactgattacctgctaagatgaaaaaaaaaaaaaaaaggaaagaaaagaaaagaaaaatcttctctagaggattttaacaggaccagagtctaatatataatactcaaatgaccataaggcaatcccaaattactaaaaataaaaaagagcatctcaaaagtcaatcaactgacatcaatccccaaggtgacccatgatgttgaaattattggacaaagattttaaaggagttattgtaactatcctctatgaaaagaaaaaaattcttttaaaatggatggaaagaaatgttgtaaaaaatagaaaatataaacacgaagtaaatattttaaaaataaaaaataactaaaaaataaactggatgaatgcaatagcagaatggagatgccagaaaaaaaagaagagtcattgaatttgaaaagtagatcaacagaaataatcctttataaataagagagaaaacacaaataaaaaaatatgagcagagcctcagggacctgtgggacatgtcttacatttgtgttactagaatcccagagggggcaggtaagagattggtgcagaaaaaaatagctaaaaacttctcaaatctgtggaaagccataaatttacagatttgggaggctgagaaacaccccccaccaccaaaaaaaaaatttcatgcaaattctcatacttaaaacactaaaatccaaagataaagaaaaaatattgaaaacaacaagtaaaacaaacactttacatatagaaaaaaataattcaaatgacaacgtattttagtgaaaatcatagaagccagaaagcagtattataatctatttgaagtattgacagtgaaccattaattctaaattctatattaaccaaaaacattcttcagaaaaaagtgaaataaagaccatctgatcatagcaaaattaaactagaaatcaaaaacagatatttaaaaacctctaaatattggaaaattaaataactcactttcaaataatcaaaatatgagagaggaagtcaaaagaaacattagaacatattctgaactaagtgaaaatgaaaataccacaagtgatggtcagttctgtattttcaacttggctaagaggtagtccttgttatttaatcaaacatgagtctaggtattcctgtgaggtattttgtagacatgattactgtataattattttgctttaagcaagaagattctgagttgaaaggcgttaagagcagaactgaggcttccctgaagcagaagaagacattctaactatagattgcagcttcagctccaacttatgcccaagagttccagtttctaatggcttgccctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttagagaaaaaagttgtacattaaatactgaaaagttacagcactaaatactgaattataagtgaaaaattcaaatcaataacctaggtttccatattaaaatattagaaaacaaaaaccaaattaagccaaaaccaagcaaagaaaaagagaaatgtcaaaggcaaaagaaaaaaaataaatgaaatttaaaatagaaaacaacagatagagtcaatgaaatcaaaaggtggtttgttgaaaaggtcaataaaatttgataaacttctaagaagactgaccaaagagagaagtagcaaattactattagacatgaaagaagacataatactacagacctcacaggcattaaaatgatattaagagaaaattatagacaactctattcccccacatttgacaactcagattaaatgaatcattttattgaaagataaaaactaccaaaactgacaagaaatgggaggtagtggtcacctggatcagcagtctgaggcactcaacccttactgtgcgtagattctggtgcagcgatgccctctctgctccgtgcccaagcagatctccgggcattcaaagcaccggctcacccggattgacagcctgagctgcctcacctttcctgcacagaaatcatggtgcatccaggccctctccacttcatgcccaagcagatctccaggcagtcaaagcaccaagtcacctcgatcagcagactgagccacccaactcctcctgtgcagagactgtggtgaagcagggccctctctgcccaatgcccaggcatatctccaggcagtcagagcacaacatatttgcatggattataagcctgaactgccccaccctttctgtgcagaaattgtggtgcagtggggccctctacactctatgatgaggcagataaccaggcatctggagcacacactttcctgaatcaggagtttaggctgaccttgccacttgtgcagagaacttcaggcaaaaaaggtttcccagccccttgcccagtcacacctttgggggcttggtggcccttcactcatttcttccttggtgctgatgcatgtggctgacactgggggacctgtacatgggcctgcccggtctgacctcacccatctgggtccccaaacccctcaggactgaggagacagctcagacaactgtgggctccatggatgagcccattgctagaggtagaagctagagcttctactggtaaacaagaataaaatatatacccaggcatgttggccacaaccagctcttacccataagtaccatctactggcttgtaagtcaaaccacagaactcaatataaatttaccaagaggaagtgcatatggctatagaagcaaaacaaaaaaccatattcaacattctctatggtcacaccccacagggagtggggggaaagagaaagggaaagaaaaaacccgctaatgatattatagggaaataaagaaaaaagggaaaaatcctacacacagttaaataattataaaaattagaagtcctattatctctggatgagaaaaaaatggtgcaaaaattctggcaccatgaaaaatctgaatgtagtgatgccaccaaaggatcacagtagttctccagcaatggtctccaaccagaatggaaattcagaaatgacaaagaatccaaagcatgtattgagaggaagctcaatgatatctaaaacaaggttaaaagtcaacacaaataaactcctaaataaatcaatgaaatgaagaaagagacaaacatcttaaaaagaaatcaatcagagcttctagaattgaaaaactcaaggaattgcaaaatataattgaaagctttaacaatagactggactagaaagaagaaataatttcaaagcttgaagactagtcttttgaactaacccagtcagacaaaaattaagaaaaaaaatttagaaaaatgaacaaagtctttgagaaatatgagattgtgtaaagtgaacaaaccaacaaattattggcattcctgagagagaaggagaaaacataagcaaccttggaaacatatttgaggggctaattcaagaaaacgtccctaatcttgctagagaggtagacatctagatacaagaaatccagagaacacttgcagtatcccatgcaaaatgaacatcaccaaagcagttacccaccagactgtccaagatcaacactaagaaaaaaatctcagaggtagctagagaaaaagatcagatcatgtacaaaaggaaccacctaaggctaacagtggacttctcagcacaaacctgacaagtcaggagaggctggggtctatttttagcacttttaaagaaaagaaattccaaccaagaattcacaacttgtgaaattaagctttctaagtgaaggagaaataaaatattttaaagacaaacaagtgctgaaggaatttgttactattagaaccggcttacaagagacccttaagggaattataaacatggagacaaattaatgacacctgctaccataaaaatacacctaagtgcatatctcacaggccctataaagcaaccaaacaatagaaactataaagcaaccagcaaacaacttcacaataggataaaaatcttgcatatcaatattaaccttcaatgtaaatagtctaaacaccccacttaaaaggcatagagttgctagttggataaaaaacaagactcatccatctgtggtcttcaagagacccatctcaaacataaacacactcataggttaaagtaaagggctggagaaggttctataacacaaatagaaaacaaaaaagagcagtggtcagtattcttaaattgcgtaaaacagactttaaaccaccaacattaaaaaaaggaaaaagaggggcatcaaataatgaaaaaaggttcaattcaacaagaagcctttactatcctaaatatatatgcatccaacattggagcacacagatacataaaacaacttctagaactgtagaaaaaacttacacagccacacaataatcatcagggacttcagtaccccaatgacagcattagatggatcatcaacgcagaaaactaaaagaaattctgaacttagacattttgaccagttggacctaatggacatctatataacactccacacagaaaccacagaatatacattcttctcaactgcacatggaacatacaacaagattgaccacattcttggccataaagcaagtctcaataatttaaaaaaaaattgaaattacaccaaccatactctcagaccacaatggaataaaaatagaaatccacaccaagaaaatcccctgcccccaacagcacaattacatggaaatataacaacttgcttctgaatgtcttttgggtaaaaaacaaatttaatgccaaagtcaaaaaaaaaatctttgaaataaaagactccatataccaaagtctctgtgatgcagcaaaaacagtgctaaaaggaaagtttaaagcactaaatccctacctcaaaaacttagatctcaaattagtgatctatcattgtacctagagaaacctgaaaaacaagaacaaactgaccccaaagctagcaatagaagagaaataactaaaacaagaccagaactgaaagaaattgagacccccccaaatccatacaaagggtcaacaaaaggttcattgtttgaaaggataaacaatttcaatagaccactacttagattaaaaaataaacagaagaggtccagataagcacaatcagaaacaacaaaagtgacattataaccaataccatggaaatgaaaaagatcctcagagagtataatgaacacctctttgcctgcaaactagaaaacctagaggaaatggataaattcctggaaatgaacaacctcccatgactgaatcaggaagaaattgaaaccctgaacaaatcaataatgagttctgaaattgaatcagtcacataaaaaagccccaaaccagagagattcacagctaaattctacccgacaaagaaaagctagtatcaattttactgaaactatttcaagaaatcaaggaggaaggactcttccctgactcattctatgaaaccagcatcagcctaatactaaaacctggtaaagacaattaaaaaaaacctgcaggccatagacacaaaaatccttaacaaaatactagcaaatcgaatccagcagcacatcaaaaagttaattcaccatgatcaagtaggcttcatttctgagatgcaaggttggttcaacatacacaaatcaatacatgtaattcaccacataaacataattaaacccaaaaatcatacaattatctcaatagatgcataaaaagccttttataaaattcagcatctcttcataataaaagccctcaagagactaagcatcaaaggaacatactccaaaataattagagccatctatcacaaacccacagccaacataataccaaacaggcaaaagctgaaagcatttgaaaatgtttcttagaactgggataaaacaaggatgcccattctcaccactcctatttaacatagtactaaaagtcctagccagaacaatcaggcaagagaaaaaaataaaaagcatccaaataggaagaaaggaagtaaaactctttgtccacactgctgataatgattctatacctataaaaccctaaagactctgtcaaaaggctcctggaactgacaaacaacttcagtaaagtttcatgttataaagtcaacatacaaaaatcagtaccatttctatagaccagtaacattcaagctgagagccaaatcaagaatgtaatctaatttgcaatagccatacaaaaaacacctaaaaatatatctaaccaaggaggtgagagatctctacaacaagaacttcaaaacactgctcaatgaaatcacagatgacacagacggaagaacattccatactcacaaattggaaggatcaatatttttaaaatggccatgctgcccagtgcaatctacagattcaattttattcctattatactaccaatgttatttttcacagaaccagaaaaaacaattctaaaatttatatgaaactcaaaaagagcccaagtagccaaagcaattctatgcaaaaagcagcagccagaggtatcacattacctgacttcaagctatactacaagcctacagtaaccaaaacagcatggtactggtacaaaaacagacatattgatcaatagaatagaatagagacccagatataagccacacacctatgaacatctaattttcaataaagtcaagaaaaataagcaatgggaaaggactccctattcaataaatagtcctgggatagctggttagctgtatgcagaagaatgaagctggacccctacctttcaccatatatgaaccttaattcagaatgaattaaagatttaaaagtaagacctccacctataagaatcccagaaggaaacctaggaaataccattctggacagaaataaattctgccttgggacagaatttatgaataagtccttaaaagcaactgcaacaaaaacaaaaattggcaagcaggacctaattaaataaaagagcttctgtacagcgaaagaaactatcaacagaccacacctacagaatgggagaaaatattcagaaactacacatctgacgaaggtctaatatctagaatctctaagaaacttaaacaactcaacaagccaaaaccaaccccattaaaaagcaggcaaaagacatgaacagccacttctcaaaagaagacaacaaacatatgaaaaaattctcagcgtcactaatcatcagagaaattcaaatcaaaaccacagagataccatctgatgtgtcagaatggctactattaaaaagccaaaaaacaatagatactggtgaagctacagagaaaagagaacatttatacactgttgatagaaatgtaaatttgtttagccactgtgaaagcagtttggaaacttcttgaagaatcttagaactacaattcagtcaacaattccattactggagatatatatatatatatatgaatataaataattctaccaaaaagacacatgcacttgtatgttcattgtagcactattcacaacagcaaagacgtgaaatcaacctaagtgtccctcaatggtggactggataaagaaaatgtggtacatctatactatggaatactatgcagctataaaaatgactgatatcatgtcctctgcagtaacatagatgcacctggaggccattatcctgagcaaattaattcagaaacagcaatctaaatactgcatagtctcacttataagtggggcctaaacattgggtatttattgacataaagatgggaacaatagaaatgggggactactacaggggaaagtgagagaaggggacaaagagttgaaaaactgtcaggtcctaccttggtgacagaatcatttacattctgaacatcagcatcacgaagtatacccatgtaatgaaactgtacatgtatccctgaatctaaaataaaagttgaaattataaaaaaaaagaaaataaggagatagaatacgaaaaatggcctcccaatattttccagcttaatgcctggaactgtgggtatgatgagatatcattcctgtgtgttaccctatattgaaaagggagattattgaggtataagtaatctaatcacatgatccatttaaaagcctagtgttgtctccagttgagaacagagaggaaagtcagagacatcccaagtgtggtgaggatacggagcaagagaaactctaacattgctggagggaacataagatagtacagcaactctagtaaacagtttgataatttgttataaagttaaacatacatctttataacccacctaggccacagcacagcagtaccctacagaaatgaacactatgttaaatcaaaacctgtatgcagatatttatagcagcattcttcattatcaccccaaactagaaataccctaaatgtccttcaactggtgagtggataaagaaacagtggttttgttgctgagaagtattccatgttatagatgaaatactactcagtaataaaaaggaatcaattgctgatacatgtaacaccatgaatgaatctcaaatacattgcactgagcaaaaacaaaacaaaaacaaaacagattcaaaggttgactattgtatatttccatttatacgactttctaaagaaacagacactatagagacagacaggtagtggccaaaggttaggaaatggggattaatattgaccacagaggggtaatactaggggatcttgaggggtgagtgaactgttctgtatcctgattctggtagtggttatgtgactcagaactatacaccacaaaagagtgaattttattgtacataaataaaaaataaaaacagtgaactgctttgattagcttctacattgtaatctaagattttaaactcaaatttgtatttatgtggcaatgaagggcatgatgatactcaccaagtagttttaggaaaaaatgatttactcagtttaaatatttaccttgaaaacaaacctataaggtgaacacaatctcatttttaaccgcattaaatattagttttcttttgtttttaacttgaactacattgaatatcttttttctaagctgccttcgtctaatagacattgctcaggtcttaaagaatcatcaaagcatggatttttttctctccaccgagctttgataagaaagaaaacaaaagcccacatatatttggataaagtgcagcaatctgttccaaatatcatgtaaaatgtcttcaaaacctaaataagcatgctttttgagcttcatctcctgcctagttctccactcaacactcccaccacgatgaactaattaacaacagtaatatggttattacaaattatttaccatcttctctgtgacagacactttgctagatgctttacatatgccaccacattccaggtaaaataatggttcctattttacagacgagaaaacacactcatctaggttaaacacttgcccaagttcacgtatctggtaagtggacagagctgtaatttcactgtgcgtctgagtccagatggctatgccctttctattactactacaccacactgatagttttcttattttcccttaatagtttttcaaatgtgatgccttttttcaccttatttctagcaaaccgactgacagtcttagaggagaacagtgtcccctctagaacgtcttccctaatctgctatgttgaatagaagaatagattggaaccgtaagaaacagcccagttcttatttcaactcagctacatattcatatttccacacagatggatatttattgagtaccccctgtgtgcgagggattgtgttaagcaatggagattagatcaaaaattttataaaagaaataaaccataagaaacttttgtggggatcttatgagtaggaaataagcagaaaagtccactccaggcagaggcaaacagtactaacaaagaaacggaaaaaaaataaaataaaaattatgctctgagaaactaccctttctgccccttaaatgctctttgcttctcttcacagctgtctgacagtgggaattggatgctctaactgcagtgaaatgaccaaggcgtatggagttactgagtgagctgtttgtagagtaatataagctcaaagaatagctagctcaaggagtggaaaggggaaagatggaacgcacacctcaggccaatgtagatttttactccaaatagaattttcatagcctctttaattaaaaagatactatgcaaggctgggcaaaacttgtccaattctgagctacccaagctaagtctttacttcatttaaatcctattaaagcacaatcttctcaaatatccttttatgacatctagaaagtcttattcttcaatttaattttatgagagtgtggattaaaaatatatatgaaaaacaaaaggaattatccaaaaaggcatttccttcaggaaagaaaaaaaaagtcctccacaaagtaaaaggaatattttagttttattatttttttgttcctcttacacatgaggaataaaaagagaatggaaagtctaaaaatcggaattaaaagctactactgcagcgtattttaaattttattctatatagctttcagagaggaaaagcgattctgttattaccctgcataatttttttatagcagagcatagatgtgttgctaatccaatgctaaaatgactatttggcttattcagaattatttgaaccattaactcgcatgagataagcatgatatgcattaatccttttgtgatctaattcatcagtctttccaagttactaaagctattcttcacagattctttattcttctatcctgaaaatattgtgttttgtttattctgcttatcacaaatcacagagaagtttcatttgctttcttactatttccttttaaaaataaagtcacatttatattgtcaggtaaaatacctacacagaggaaccaagaagaatcggcaataataagtggttttgagactggaaagagaagcagtagagaaagtggacaagcagtgatgaaaatttacttgactacacaatggatttgcatgggaaatattgccctgaccattccatatttgggtaggtactatttggtaattggtgttcattcattagtgggtatgatctaaatatggatttcaaaatacactatgaaagaaattccagatcagacttttgacttgaatggaatatttccataagctaaagatctacagctgttcattaatttcagaccaacatttttggaaagtctcaaaccactccatatttccatgaggagtgcctagaaatgaacctagaataaaacatgctcatttttacaggcacctccgagcttacagtttcttatctgtaaagggcaacattatgcttactatcttcataggattaagagcagaaaaatcatatggaacttctacccagaaatttctttcataagaagcacaaaatacttagtgagattttgtttaagtctgtccttgggcatgataaatcaaaactacatctgtgtatgagacatggatcctgtattataaaggaaatcttcagaaagtctaggcttttcttgttgaaggataaagcttagttaacattatttggggatgatctagctagagagcaaccactatagaaaattattacttgcttaatcaggacttgtgctatttcagataacattaatgtaggagtgaaagttaatcttatttactgattttttattagtaggcaaaccagaattttaacaagatattggaaatgtttaaaaatattaatgcatttttgagctttccatttctaccattttaaaaagaacttgtgttttatagtgtcctgtgttaataaaaagctattcttacttatacataaaataaagatgctagagatctattttattagcctaagctagtataacgtatatttaaaataattttaaatatttttcttagaaattataaaagttaaaattgaaaatttaattgatttcttcccaatttataataattattcctgtattctaccaaccaacatttatttagtttctattgatttatcagagtagtcatttgatcacactagagtgggattaaaaaataagcacaatttttttaatttcaaatatcttgcagcctcggaggaagaaaaagatatgggcatatgtaattatataacaaaatagaaccagaaattttagaaaatgtgatatgtgagttatataagggaagcatgccatttggggaatcaaaaaaagaacaagattacagaagaaatgtgagattactcagttctttcttttttctggtcatggaaaggttcagactgaacactgaaaattttttggagaccagctgaaaaaccatgccatggtcataatttgtcattttactttttatcctcactaatattcatgagtcctcaatctttatttttagattccatatctaaagttaatactcaagattatcgatggtattctaaactaagttttgtacaatgcacttttctgaacatctaagttatctgaaaacaacagttgtgaccttcattactgttatagatacagagattaataagaactgatatagaggtgggtaaaaccattgatatagagattcgtaagactcctggtcttagaggaggtccatccattaaaggaagtggattcaagaacatataaatctaatatactgtaatagcacaatgtactgggtgatcaaaaagaggcccttgtttgaaaatatcacacatttctgaaaaccatgtcttaaaacaaaaagtgaaatatctagcatagtgtgctaatcttttcacctctgaagacaatagaaaagattaaattagtaagtaaaggagagaagtaataaagaaaaaaaaaacagaaatctaaaaccaaaaacttagtaagcagtactaaaagaatgtgtcaaaacatgaaggccagcttatcaagagaccatccaaatgctacctatataaaaatgaggaaaaatgcaagcatggctattgggaatcacaaggacagaatttcactcatatcacttcaggctgatgtggtcaaattgattaggaaatgctggaaaatgggtctgcagagtactagccaattgatgaggcagcattctacagggtctcaatctaatttagtattaaatactaattagcatcaccaatttcagttcctgatataacagagtaatgaataccagatcaaacttcctgccataaacaactatatgactagaagttaatattttcagacatggataagagagaacacaaggctgtgatctgtgaaagaaaaacacaccaagtgagatccatactgatcctgaattgttgccagagggcacatttcgagtcttgacatatggagtggagcccatgcaaggaggagcattctcagctggatgaaggaaacacattggactacagagattgtgaggggcaggaatctttcagcagggaagaggacaggaggacgctctgcagataaggagctccagaaatctgcctacgagtctcctagactgtagtgagtattacagtgtacataagcaaggctagactttgtgaggtctagcagagaataacttctggggaattgtgagctgaatagagtttctgaagcctgcataatatggggaaatactgtagttctgacattcagagtggagagactttcctaatgcctcaagcattcagctgaaatttcataaaaattgcaaataaagaatagggatacacgagccttaaagtagtctttagacccattctaacaaagccaaatccaagtctccacagcataaatctgattctccagaaaattaactatcctctgttagaaagagacaatgctttttaaagaaagacaataatatttcagctctaaatatgaagtgaccacaatgtacatcagaaaataaaataactactagaatgtgaagcaggaaaatatgacacataattgggaagtataatgtcaacagatgtggataagactgatgctgtaattagcagataaagattataaaagtagctatcataaatatgttcaatttttctcttcaaaaagataaagtaagcatatacttatttccttgatgagattatataatctcattaaagaaaaactacaaaaaagaatagaaattctacaactgaaaactacaagataaatttttaaagaaattataggctgggcgcggtggctcacgcctgtaatcccagcactttgggaggtagaggcaggcagatcacgaggtcaggagatcgagaccatcctggccaacatggtgaaactccgtctctactaaaaatacaaaaattaactgggcatggtggtgggagcctgtaatcccagctacttgggaggctgagggaggagaatcgcttgaacccgggaggtggaggttgcagtgagccgagatcacgtcactgcactccagcctggcaacagagtgagactccatctcatttaaaaaaaaaaaacaaaaacaaaaggaattgtatagccttatcagtagatggacaatgccaaagtaatattagtaaactcgcagacaagaataaaaggagtcatacaaactaaaacaaaacaaaaaactgtaacaaaaaaaaagaaagaaaagagcttcaatgatctgtgagacaatgtcaaatagtccaaatagtctaatgtataattgaaatgctagaaggagaagagagagaaaaatttggcaaaaatattatttgaagaattaatgatccagctgctgaaaacttattttactattttaccgaaaataaaattttaaaagctgtcagaaaaggtacattacatacaagagaaaaatgataagagttgttgctgacttatcagaaacaaggcaagtaagaagaaaaggggacatgatagggctgaaaaaaactcttgttcagcccagacttctatacccaacaaaatatctttcaaatataaaggtaaaataaagacatttcagtaaaaaactaaaatgaggagaattttaaaggcaagaaatgtcataatatttttatgttaaaggacgatggaacacatatctagttgaaagaatgaattgcacaagaaatggtaaaatgtataggtaaataaaacttgtgtttcttggagagttaatattttgaagagagactgcagtaagttaaacatgcacattataatctctagattaataaatagtaacctaaaaaggcatggcaaaaatgtcaataaaggagaggaaatagaatactaaagattattcagttcaccaaaaaggaggtagaaaaggagaagttgaagtaacagagcaaacagaacaaatagaaagcaaaaatgaaataacaaagagaaaatatagaaaagtagaaaataaaatcatagtgtgcttaatctaaattgtaaataattacattaagtgtcaacagactaaatggcccacttaaaaggcaaagactgtcagattatatttaaaaagcaagagtctggctgggcgaagtgactcacgcctgtaatcccagcactttgggagaccaaggcaggcaaatcacctgaggccaggagttcaagaccagcctggctaacatggtgaaaccccgtctctactaaaaatacaataacgtagacaggcatggtggcgaatgcctgtaattccagctactcgagaggctgaggcaggagaatcgtctgaacccggaggcagaggttgtgatgaggcgagatcgcctcactgcactccagcctgggcgacattgtgagactgtctcaaaaacaaatgaatgaataaataaataaatacaaaaattagctgggtgtggtggggtatgcccatagtcccagctactgaggaggctaaggcactaaaatcgctagatcgttagaaccgaggaggcggaggttgcagtgagctgaggtcgcgccgctgcactccagcctgggtgacagagttagactctgtctcggaaaaaaaaaaaaaaaaaaaaagcaagagtcaactatatgctgtttataaggaatattctttaaacacaaagacacaggtcaaaaggaaagggatggagaaaacatcatgaagatgttaatcatgtagaagccaatatagttatatagataccttacaaattagacttcaccaagtaatgcattatcatagataatgatgcatattttataatgttgaaagtgacaactcatcaagaagacataaatcttaaatgtgcattcatttcacagaaaatctctcaaactctcaaagtttctaaactaaagggagaattagatttgttcacaatcgtagttaaaaacagtaacaccagtctttcagtaattgttggaagaaatgaacaaaagtctgtaagatatagcagttttgaataacattataaatcatcttgacctaattaaaacattacacataagaactgcaggatacatattcttttcaagatagatcatctactagtttatttcagactatcaataatcacatagattgcattctctggccaaactgtcatacattaaaagttaatcattattttaagaaaatacgcacatatttagaaattaaacaacacagttctaaaatacttatgtgtcagacaaggaagcccaatggaaatttttaaaaattactgaacataaggaaaatacaaacactatgtattaaaatttgtagaatgcagttaaagcagttcgtctgggggaaatttatagtgttacatgtctacattagaaaggaaaataaaagctataaaagcaatggtctaagatttcatcttaagaagataaaataaaaaacaaattaaattgaaagtaaatgaaagggaatgttaaaaatgagagtgaaaaaaagacaaaaaaaaggaaatcaacaagatcaaaatttgaagaaaagattagtaaaattgattaataaaactcatcacgatgaaaaggtaaaacaagaatcagcagtatcagaagcaaaagaagggacctttctacagacattataaagatgataaagaaatattatataattttatgctaattagttttacaatatagattaaacgggcagattccatgaaacaaaacttagcaaaactaatagaacaggaaatggaaagtgtgaccaaccctgtatacattttagaaacttaattttaattaaataattcttaggcacaaatggcttcactggtgaatactatcaaatatttaagagctgtacaatatccatttagcatattctttttcagagaatagagatggaaatcttcgcattttattttatgaaaatagcatatctttgataccaaatccagacaaaggggaaaaaaacccctcaaaatcctgaccaatacctctcatgaacccagacacaaaaattcttaacaaaatattagtaaacaaaacccaataacacatttttttaaaaaaaggttctatataatgactaaatgaatttagtacaggaattcaagcttggctaaatatacaaaattaaattaatgggatttactccattaaaatattaaagaaaaaaagcatataatcatttagattggctcaaaaaatctatttttaaaaactaaacagtcaatcatggaaaaattcttagcaaactagaaatggggggaagtcttcaaactaatacaatgtatctgctaaaaacttatagctaatgacataaatgattataaaatattcaacacttttcttctgagatctagaaaaagacacagatgtatattgacagcatttcatttaatattttactagaggtcctagatagttcagtaaagtaataaaaataaatggcatagagattgtaaagaggtaaagccattgttgtttatagacactgtgattgtgaacacatacagttctaagaaatccgcagaagaaaaattcctgtgaaactaaagtgaattcactaatactgcagaatacaatccaatctagaaaaaaattcggattctatataccggcaataaacatttgaaaaataaaaacaaaaatgtcattcaaaatattcaaatcataaaacttttagggttaaatttaatgggtggtgtgcaagaatgctctgctgacacaattaaaatattgctgagagaaattcaagaaagtccaaataaatggaatgatataccatgcttagggtttggaaggctcagtattaataaaaagtcttttatctttaaatagatctaaaaattcaatgtaattcttatcaaagtctcagaagccttgtatttttaacagaaacaaatggattctaaagtttatataataattcaaataatctaaaatggccagaacaatctaaagaacaaagttggataacttaaaaacttaccgtaaagcttcagtaatcaaaatagtgaggtattcacattaatataagcaaatagatcaatggaacagaattaagagcccagaaatagatccatgcttacatactcatatctgtgtgtgtgtctgtatgtgtgtgtgtgtgtgtgtgtgtgtgtgtgtctgtgtgtatgcaaaggtaccaaagcaatacaatggggaaaataagctctttccaacaaatggtgctgctgcaactagatattcatataggaaaaaataagcaaactttaacctctacttcatatcatatcattttcaatgaaccaggataactaaaactataaaaagtatacaaaaaatgtacaaaaagatctttttggtcttaaggtaggcaataatatctgaggcagaacacaataggcattaaccattaattgaaaaatgaataaattatatttcatcaaaatgaaaaatcttctcctcattaaaaggcctttgcaatgtaaagctatttgttgctccatggttgcctgaatgccagcacccacccccacttgttttgaacttttacctagtcattgcccatctctgggtactcatccctaacatgtatattttcaagcaataagtctcatgatgacttcaccgttttaccccttctttcctttccatagtaactcagttacattcaaattacccataagaaggcttcctgcatgccacagctacttcacccatgaccctcagtaaagccacttgcctagaggtccttattctgtttcctccctgcctgccacaaacgtttggcttttgggtgactttgcatggccctctgagcatgtggtgtctccttctctaggacctatgagtataataaatcctttaatttcttatgcctctccagatataatttccgtgaccatactggagtgaaccttaaagaccccacaaggggtatttcctcccccacttatgacacagccttaatgagaaataagcctgtaacagatagaaaaaagtatttgcaaaacatatatctgacaaagaacttgtacccagaacaaatatcttagtaatacaaaataaacatcttaatattttttaaacttttattttatatttaggggtacatgtgaatatttattatataggtaaatttgtgtcattggggtttgttgtacagattatttcatcacccaggtattaaacctagtacccaatagctatcttttctgctcctctcccttctcttccccaatcaaatagaccccagtgcctgttgttttcttctttgtgttcatgacttctcatcatttagctcccatttataagttagaacacatggtatttggttttctattcctgcatttcataagaatgaaaacagaaatctcacgaacgtctcaataaatcatctatgtctagaataccccttctctgtctcctgagttcaataatatattctacttaaataactgagaatggacggcaggccttatttgtttacatggattccatgaaatgcaggagctacattttctgttactgctattgtttgttagggattagtacccagagatgagtacccagcgccatccgcgatcctgcaaaagacacggtcctgttttttaagactgcatagtatcccatggtatatttgtacctcattttctttatccaatctgtcattgatgggcatttagattgattccaagtctttgcttctttgctattgtgaatagtgctgcaatgaaagttcacatgcatgtgtctttatgttagaatgatctatattcttctgggtatatacccagtaatgggattgctgggttgaattctagttctgcttttagctctttgaggaatcctcatactgctttccacaatggttgaactaatttacacccccaccaacagtgtataagtgtttccttttctccacaccctcgccagcatctgttattttttgactttttaataaaagccattctgactggtgtgagatggtatttcattgtggttttcatttgcatttctccagtgatcagtaatgttgatcttttattcacatgattgttggctgtatgtgtgtcttcttttgaaaagtgtcccttcatgtcctttgcccactttttaatggggttgcttttcttttatacatttaagttccttatatatattgggtattaaacctttgtcagacacacagtttgcaaatattttcctccattctgtaggttgtctatttactgagagtttcttttgctgtgcagaagctcttaagtttaattagatcccatttgtcaattttgcttttgttgcaattgattttggtgtctttgtcacaaaatctctgcctgttcctatgtctaggatggtattgcctaggttgtcttccagggtttttatagttttagattttcaattgaagtctttaatctatcttgagttggtttttgtatatggtataaggaaggggtccagcttcaatcttctgcacatggctagccagttttcccagtgccatttattgaatagggagtcctttccccattgcttgtttttgtcagctttgttgaagatcagatagttgtaggtgtgcagcatcatttctcgactttctcttccgttccattgaccagttacttcacaaacagttatttacaactagacaacatgcacgtgaaaaactattcagcatcattagccatcagggaaaatgcacattaaaaacacaattgattatcactacacacccaatggaatagataaaattgaaaacactggtgacaccaaatgctggtgaggtgaaacaactccaatacccatacattgctgttgcaagtataaaatggtactgccattttggaagttctgatagtttcttaaaaggttacagatatacctaccataagattcagccttttcactgttaaatatttacccaataaatattaaaatctatgttgacataaagacttgcacacaaatattcatagtatctttattgatcataaccccaaactgaaacaccccaaatggtcatcaaaaatcaaaaggaaaatagataaactgtgatagaatcgtacagtgaaatgctgtctggaagtaaaaagcaaagatcgattgacacatgcaacatgcgtgaatctcaaaaacatgatgttgagcaaaaatgtcaaacagaaaaagaatacatattaaaggactatattatatgaaattctaggataggtagaactgacctatggtgaaaggaatcagagcattgattctctctgagagagtggttgattgagaaaggatccaaggaaattccctggggtaatgaaagtgttatatcttggtggaggtgtattacatagacatttacacttgtcaaaattcactgaattttacagctatggcatatgcatttcactgtaaataaataatattttcatttctacaagactacccatgtgattagtaataaaacctgatacttgcttctgcctttcctaggagagccatttaatttcttttctcccccattactgggatgtacaacaaatgataatcaaaatagcagattttgacagtactgaaattggtcagaacactgggaagatactgcataagacaaaagaactcacttaaatgataagaagaaatgggctgaattcagaaaaccagctgaatttatttaatatatttttccctaacattttctacagtaagcccaacatgatgtaatatatgagggtattaagaagttaaggcacacttggaaaattgccattcagacttatagattaaacaaatatcagatgtggaactacattcttaatcatgaaattttaacttatactgtcagactatacaaattatttggaacatttcctccctcttcaaacatttagaactataggggccaggtaaacatcaaggagaaattatgcataaataatacaggcactgtgctttcacagagtgtttttcctggtatttaacatttgccagtgtgtctactgtgtgcaaccttccccctcaggatttagctgtggtggcaataaaggcagtgaagttaggaagactctcatcactactatcaacagccacattgtgttcagcttcttggttgacttaaattgtgcaatcagggtctatccacacattcagctatattctgtcacttatgatggagccttttgtgtctatgagttaaaggtgtccagggagggaaatgtaatgccctgactcattccaacctttaaaaacaaagcattaagtcaagaatatagtaaagaacatcccagtttcacatgttcaaactttggttgaactaatttgtaactgcaaagaccattccaaactgtgtctagtggtcaagactcctttatgtctctttctctatttggaatgttttctctctctttttccctgatggttaaagccctactctgccctactcttcactcaagactggcaaataccacaaccttttcccaataaattacatcatcaactttaggtattttaaatatatttgctcatgtctcttttttacaggactaggagctcattgagggcaggtattttgtaatattaatctttgtccctggggtctggttcacagtacatgtcaaataactgtttgatgagggaccaatgacccgtagaaagcagaaattttgaaataccatcactcctaaaattagattaggtgccaactttataaagataatttcagcttaagatattcagttatgttttagattattttttctcgagttttcctctacagtaatattgctttttatctcaagcctaatctactttcacatctttgagtctgctttcaattttttataggaaatttttttttatatttcattttaaactcttttgtgttttatatttggtcacccttaatagagtgtgccatttatccaccatgaaactaactctgtccagattactcaccattttatgttccctgtcagctttcttcacatcagcaaacctgaacacttttcaagctatattcctatctagggcattcataacagagagtggtttctgtcatcatgaataacttttctttctttcctaaaaacaaattggggattattgtacacaatctctctcacataaggctttctgatttgtctgatttattccagtatgatatgcaatatcaaaagtacattggaaatcttaataaattatctgtacctagagtacctcttctgtctcttgaatgcaataatatactctacttaaataactctgagaatggatggcaggtcttatttgtttttgtgaatcccagtttacaaaaaaataaaaaaggtgtttttttttccagatgactgcatatgtatttcaccttttatttgtttactttttattgatttaaagtcatatacaaaagcaaaacaaaataagacaccatgtctggctgtatatcaagcataaaaaacactataattaggtaaagtttcagcaaacaatcagcaacaagatggtttagttcctggacaacaataatgaaactcaatgactttgttagtccctcacactgtcatgattggagataaaatttttaaaatcctatgccaacaaatcaaggacagtagtgtcactgcttgggtggcaggggaagcttgccatataaaaaggtgaaagaccttttcaactattttggtaagagcacctcaccttgatttctgttctttttggcaaatatttccaacacgaagtctctatgcaagagttgactttgaatagtataactatcattactattgtatttgattatcttccccaaattattcttattctagtgtttttcaagttttaatgaattctgattctattagactactaatgtaatgaaagcactctaccctttcaccaagaaatgtgcatctataattctctatacaatctcacagaatagtatgatgggaaaagagatacaaaacaaacacaaataagaagaaaccatgcaaatacatggaaattaaataacctgctccttttgggtcaaaaacgaaagcaagatggaaatgaaaacattctttgaactgaacaaaaataatgacacaacctaccaaaacctctggaatacagcaaaggcggtactaagaggaaagttcatagccctaaatgcctacattgaaaaggctgaaagagctcaaactgacattctaaggtcacatctcaaaaaactagagaaacaagaacaaaccaaacccaaacccaacagaaaaaaggaataaccaagatcacagcagaactaaataacatagaaacaaacagacaaaaaatacaaaagataaatgaaacaaaaagctggttctttgaaaaaataaataaaattgacagactattagcaagattaagcaagaaaagaagagagaaaatccaaataacctcactaagaaacaaaacagtacatattacaactgacaccactgaaatacaaaagatcattcaaggctactatgaacacctttatgcacataaactagaaaacctagatgagatgaataagttcctggaaaaatacaacctttcctgcttaaatcaggaagaattagataccctgaacagactaataacaagcagagagattgaaatggtaatttaaaaattaccaacaaaaagtccaagaccacacggattcacagcaaaattctaagaattctaagacattcaaaggagagttggtaccaatccttctgacactattctacaagacagagaaagaaggaaatctccataattcattctatgaagccagcatcaccctaatacccaaaccaggaaaggacataaccaaaaaagaaaactacggactgatatccttgatgaacacatatgttaaaatccttaacaaaatactagctaactgaatccaacaacatatcaaaaaaataatccaccatgatcaagtgggtttcataccagggatggagggatggtttaaaatatgcaagccaataaatgtgatacaccacatatgtataattaaaaacaaagactacatgatcatcttaatagatgcagaaaaagcatttgacaaaatccagcactccattatgattaaaactctcaacaaaattggcatgcaagggacataatgtaataaaagtcatccatgacaaacccacagctaacataatacagaatggcaaaacgttgaaaggatttcctctgagaactggaacaagacaaggatgcccactctcaccactcctcttcaacatagcactgggagtcctagccagagcaatcagacaagagaaaaaataaagggcatccaaactggtaaagaggaagtcaaactgtcactgtttgctgatgatatgattatatacctagaaaaccctaaagactcctccaaaaagctcttagaactgacaaattcagcaaatttccagatacaaaattaatatacacaaatcagtagctgtcctatacaccaataacaaccaagctgagaatcaaatcaagaactcaaccccttttacaatagctataaaaaaacaaaaatacttaggaatatacctaacaaaggaggtgaaagacctctacaaggaaaactacaaaacactgctgaaagaaatcacagatgacctaaacaaatgaaaacatatcccatactcacgggtgggtagaatattgtgaaaatgaccatactgccaaaagcaatccacaaattcaatgcaattaccatcaaagtaccaccatcattctttacagaactagaaaaaacaattcccaaattcatagggaagcaaagaagagcccacatagccaaagcaacactaagcaaaaaagaacaaatatggaggcaggtaccacattacctgatttcagactatactataaggcaacagtcaacaaaacaacatggtactgatataaaaataggcacatagaccaatggaacagaatagagaacccagaaataaacccaaatacttaaagccaaatgatctttggcaaagcaaacaaaaacaaagtaaagaaagaacaccctattcaacaaatggtgctgagatatttggcaagccacatgtaagagaatgaaactggatcctcatctctcaccttatacaaaaatcaactcaagatggattaaggacttaaatctaagacctgaaactgtaaaaattccagaagataacatcagagaaatccttgtagatgttggcttaggcagggatttcttgaccaagaacccaaaagcaaaggcaagaaaagaaaaaaacaatgataaatagctgagacttaattaaactaaaaagcttttgaatggcaaagggaagagttagcagagcagacaacctacagagtgggagaaaattttcacagtctatacatttgacaaaagaacaatatccagaatctaccacgaacttcaacaaattagcaagaaaaaaacaaataatcccatcacaaagtcggctatggacatgagtagacaattctcaaaagaagatacacaaatggccgacaaacatgaaaaaatacttaacatgactaatgatcagggaaatgcaaatcaaaaccacaatgcaataccaccttactcctgcaagaatggccataatcaaaaaatgaaaaaaaagtagatatcggcatggatgtgctgaacagggaacacttctacactgctggtgggaatgtaaactactacaaccactatggaaaactgtggagattccttaaagaactaaaaatagaactaccatttgctctagcaatttcactactggatatctacccagaggaaaaaaagtcattatatgaaaaagatacttgcacatgcatgtttatagcagcacaattagcaactggagaaatgtggaaccaacccaaatgcccatcaatcaatgagtggataaagaaactgtgatacaaatatgtatatgatggaatactacttatgatggaatactacttagccataaaaaggaatgaattaatggtattcatagcaacctggatgagattggagactattattctaagtgaagtaactcaggaatggaaaaccaaacatcatatattctcactcatcagtgggagctaagctatgaggatgcaaaggcataagaatgactcagtggactttgaggacttggggaaagggtgggaagggggcgagggataaaagactacaaatagggtgcagtgtacactgctcgggtaatgggtgcaccaaaatctcacaaatcaccactaaagaacttactcatgtaagcaaacaccacctgttccccaataacttgtggaaataaaaaaatttaaaaaaatgtagaaaagattttaaaaaaggatgaggaaatatttacttaataatccattcaacaaatatttattcagaatattctatgtgccagataaaagcagaaaataaaaaaaagacagaaaaactgcagatctgactaccaaatctgatattttgttctatggaaaaaagtaacagcaataaataacaactcaaaatagataaactattcaccaaggcgattaagagaggggtacagtaaaaatacatgaaaattaaaattcaagggaaaaacaaaatttgagggaatttgtcatcagcagacttgccatgcaaaaaatgtgaaaataagttcatcagaagaaggtaaataatataggtcagaaactcaggtctatataagaaaggaagaatgttatagaaagaataaatggtaaaataaaatcttctctgcttcttattcttcaatactctaatagataagtttgttcaaaataataatgtatcttgtgactataatttatgggtgggtgaaatgaataatagtaatgtcataagggaaatgagggaagaattgggaatattttaagaaacttgcactacctgtgaagttgtatagttgtatttgaaattgaacttggattagttgtaaatgtattttgcaaaccccagggcaaccactaagttaaaaaagaaaaagaagaagtctggttaagagacagaaatcgagttgggttttagacacaaactttgagaaacttattaaatatgcaagtatagttggtggggaagatgaagagaaataaggtaagaaaatgaaatgaagcagtcagtaagataggagaaaaaccaagagaggatggtttccagaatgcccatgaagaaagatcctcataaaaggaggttaaaaagtacatttaaaagtatattattagatgttgagtacctataaaacagaatttaaacagtggttgttttggtgtggtggtttttgtgggtgatttaattttttttccattctgtttctaccttttaaaactgtcatgcagtaaatatgcaacactgttgtaataagaaataaaataaaaatcatttttaaagtattgggtcctttactcctacctaagaataaacattctttatttttacctttctactagtgtcaggttctaagtacaatacttagagatacacatattatagggaaatctgttggtaaaaatgtcctagggcacactgttcaatagagatacaataggagatgcatatataattttaaattttctagtatgcacattgaaaaaaatgtgaaattaatattttattaacttagtatatccaatgtattatagtttcaaaaatataaccaatataaaaatattaatgagctatttcacctttttttggatgtctttgaaatcctgtgtgtacttcacacttatagcacatctcaattcatatttaagtgcttgacagttacatgtggctagtatctaccatattggacagtgtgttctagatccttgttcttcaaaatatggttcacagatcagctgcattggcttcacccagaaaaaaataaatgcagaatcttaatccttatcctggagctactatatcagaatctctgtttcttttttttttttttttaacttttaagttcagcggtacaagtacaggtggtttgttacctaggtaaatttgtgtcatggcggtttgttctacagattatttcatcacccaggtattaagcctagtatccattagttatttttcctgattcctttcccttctcccatgctccaccctctgaaaggccccagtgtgtgttgttcccctgtaagtgtccatgtgttctcaccttttagcttccacttataagtgagaacatgtggtatttggttttctgttcttgtgttagtttgccaaagataatggcctcaaaggaatataaattattctactataaaggcacatgcatgagtatgttcattgcagcactattcatgatagccaagacatgaaatcaacctaaatgtccatcagtgagagactggataaagaaaatgtggtacctataaccatagaatactatgcagctgtaaaaaagaatgagatcatgtcctttacagggacatggatggagttggaggccattatccttagcaaactaacacaggaacagaatctgtttctaacaagcactcaaatgatactgttgcagctcgcttcacagaccacactttgagtagcaagactaattatatccagcccaatcattttctagaagctcttcagcagttccttaacctgttttctgctgtaatcctctcttcatgtccatcattcctccaaaaagcaattattatgtgctggttactgcgtgctaatgctttacaagttctatcatccacattttacagaagagaaaacagaagcactaatagattatgtaacttgctcaatatcacccagctagtaattagtggagttgggatttgaaaccaactagcctgcttccagaatccagtgtcttaaccaaccattatttgtttatatatctgtctcttctacttaagatacatctagctcttcaaagatatatagcttatacatcttttttctacaactatttaatacagtaaatgtttttgtaaagaagggagggagggatggcttcatttgtgttttcctgctaggactgcccttccaggtccaattgccccagaatttccagtactcaagatccctgttttataggtgctagtagacatattattgtgtggaagccatggtcagaacacctgccaggtgctatcactgtgtctatcatttcacattaatattaagaaaacatttatgaaattctataatatccaaacagaatttttgctaaaatgttttcctaattaaaaaaaaattagtataaatgataacctaacaggtctgagttttacaagtagaagttttgctaatcagtgaaatgcccataaaggaagtaggagaggagacagtacaaaactgagataattctaagtccaaacaaccactttcttgatatctaggtggtaaattttattgtacatcaattagtgatcctcttttcagattctcttttcattctaatcaatctaattccatttacatttgctcagttaacatgactgctttttggaaagggtccaattcttcttcctttggaaatttcaactctctatttctcatttgactgcaataaagtggctgggatgttcttgagagttatgggtagggaagttctttgtacccttaggtggatgcacgctttggctgtcaacacctagttgcttttcgtaggaggtgctgccaggtcagaaaaaccacttgtatcatagatggccccagtctttgcctcaaataaaacagataccagaaacagggagaagaatctgcccttttctgagaggtacaaagacgaccatggtgtgcatataccctcaccacttaagggctgtgtgccctcgggcaagttactcaggctctctgaacgttatgtttttaactgtgtcaacgtgaactagataaacactatgaatctcaggttccatctgtaatttggcattttgacttatcacctagggtttctgacagcaatgagaaaaatgatggaaaatgtagtgcagagtccagcacctgacaaataataatccattagcattttccttcaatatatttcctactgaactacaggaattttgaggcctcaacttgatattatccctattttaaactttctaatggccagctgcaaacacatccatgtcaactccctccaaaatgttatttgtcctttagatctatttcagatgtatttcttgctgaataatctttgtatgcaatgacccctgtatttacttacaactacatcatcaacatcctaggacagggtctaggttagtttcatttcccttcttgggcatttactacaatgccaggaataaacaggtgcttaataaatgccttttgttaagccaaacgtggtggctcacacctgtaatcccagcactttgggaggcagaggtgggcggatcaccagaggtcgggagtttgagacaagcctgcccaacatgaagaaaccctgtctctactaaaaacacaaaattagctgggcgtggtggcacatgcctgtaatcccagttacttgggaggctgaggcaggagaatcacttgaacctgggaggaggaggttggagtgagccgagatcacgccactgcactccagactgggcaacaagagcgaaactccatttcaaaataaataaataaatgccttttgttgatgctaggcattcctaaagtctttggaaaactttccataaccacccctcctctgcccactccagctctgccctctcacctatctctgcggccctccatcacagaccttattcacttaactgcaaattgggcactgttcctttgtttttattacaaaacatttctaacataccaagaagtaaaacatccgtgatttactctaccactcaatttttcatgaatgttgacattcgttatattattttggttctggtttttaaagatctataaatgtttctgatatagctgtgaaccttccaatcctattctcttcctccctccttggaggcaaccactgtcctgttgtgtccataagtttcatttttgctttactataaaaaaaaggagttacaatacccctcttaaagggttatgaggcttaagcaaaatttatactgtgactgacaaagagttaaaacaatagtagtctctgtcatcctcatcatcaccatcattgttatcctcactcttgaccttattatttttctctgcatattcatatgtctcctccagtaggtctttgcttttctgagatctggaactatttattttctctatatgcctatagcttagcccagttcctgatatataggaagtacacaaaacttgtaaagtaaatacatgctgtaaaggctggactgattaccttccattctctgatttcaggcataatcttaaagcacattaggcatagttcttcaccagttctctaaaatagtaacttgaccagaatatgcaggctaatatccattcaccctcaaaaatccagagtaatgacaatctctttattctttcaaggggccctgatcacctgattgttagtatcacatattcatctccaatacctgacaccagaaaaacaaaaacaaccaggacaaaactaaggttcccaaagtccagaggctgaactaaaagataatggatagatgagcactcagtcttctggcatcctcaataccctctcagccttttagattgttataacccaacttgctgtttccttttcaattatcaagatttacagaataaaaaaaggtgaacttgtctttaaaaattattcgcgataaaattcgattttgtttacttgatgctaaatactgataggcaaggaagtggcaggcaatcttactcggtttcccccatacactaattaaacattttatgcagatatcagcataattaaagaattaggaaacaataagaagtgcttgggataatttgtaatatcagtgcactgatgcattgggtccagataccaggatttgattggcaggactttattaagttttggcagcacttaggtagtctgggagcttttttatgaggctcgtgcacattaatccaagctcctgttgtcgttaatactgatgagtgaaggcagttaattgaattatgtatgaagcactgctgattaaataatatttcactccccactacagaattcgctctgctggattaacatctactgttgtctctgacactgaatgttatacggacctcttctgaagcatacactttgattctttcccatctgttcaactgatgcagcatctcagttgccactggaaccaactatccttcagctctgacatgaggtcactttggagaactgatatagttatttattagcatccgtgtaaccatgaacagaaatcctccccagtgcctcaggtgttctaagggcattattatttaaattcacggtggaatgtgaagaaaaattctaattatttatcattgtattctgcttaaggtgataggaagagaaaataactcaaggtcttccaaatcagccttaaaaataagtattattttgagctgcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatattagaccctaaaaacacctacctcattatatccatatccatggtagagttttgtctgtcaaggagaatggctttaataagatgggccagaaacccttttctaaaaacagtgttaaagaatcacctctcagactttattttcttctagacttttactactcaccaattttccttttctataggtctttttttctttcctatagtttactacaaaagatgcgtgaatggaactgaatgtgatggcaacccagagatcaacaaataggcgtagccatataagaagaaagagaataaaactgataaaatatcaagattatggttgatacacaaagttatcacagaggagtaaaaccatgtaatatgatttattgctcacatctcaagttataaaatatttggtacaaacaaaacaaccaagagaaataaaataaaacccaacacccagcatttggattattagaaaaatgtcattctttaattaaaattgttaattgcttttatgttgtgcttcacgtactacaaataagttaaaaaaatagggaataagatgcttgaaacacaaatgctgaattttatttatatggggtagcattttttaaaaaaatatgcaaacaatgatttaactaaataattgaaatttggtcattaggagaagacatcattcaaccattgagaaaattttaaaaacctcatcaggccactttaacattttcctgaaagttatattaaatccttacatttggtgacattccctaaataaggggaattgggtctaacaaaaagaggatgtaaacagagaaaagtatagccaaggttaattccaaaatttctgtaatatctgagaaagttatgtgttctttgtgcaaaggttctctgactatccaggcctaaggatgactcaactgagatggttggattttcagaactgaattcctgtgttattcttgctttcaaacttttccagtggctgacttttagcagtggaacctaactgggccagcttttgtgtctcctcacatattacatttcttcttccccaaggagctgtcatttttctccttcttgaaataaattcatctaaagagaatttctctcaatcaacttcccatcattctctctggagtcttcagaactcactattatactgtcaaaagcctgccatccatgcattcactcaaacacaactattgaaagcttaatgataatagtagttactacttaactgaactcctcagatatgccttgtcacctgtactgtgggttcagtaataaataaagcatttttgtccttgaggagctcccagtaaaccaagagaggcaaatatgtaagtagttattcatgtcagaggaagagcaccaatgaggaagcagctcattcaaatggtgaccctcccacattccctattcatggtgtcatcatccatcctgtcctccacacttcacaatcatacccctctcctctttcacctttttatattaaatggtgttttctccttcagaaatagctcatatctcttctgtaatgaactaggtcctccacatctctagcctagacaattacaatcacctctttgccactagtatcttccttccttaaattattattatttttaagcggtgctggttcaaaaatttccatttggtctgacttattcacaaaaacaagttcaatctcctcgacatggcccatggtttaaatcttcccagtgtggccctcttatatttctccagcctaatttcctatctcatatttcaggatacacaaaactttccttaattccctaaacatgccctcttctttaaattatctgtagctcacagcatgtacttttctctacttggtaagaatttcttcctgactccatcttcttcataaaaatgcttattcagttgatcagaaatcatgcccacttggcctttttgacacccaccttgtaaagggctaacagatggctacacccaaccacagcagggtaccccaaatgagagcaaaaacttaccttgtaaataacagctgaggaccccactccagccaaacacaaaacaatcacaggtgataaaaacgtcaccaagagaacttctgtaatatgcacaacaatttcccccagatctaaagatgttaataaatttctgaaaatatctaactttctcacagccaacagatgtaggctaggggttcagagcttctaggtgacagatattagattgtaccttaagcttcatgactttcaatccctctgtctggttggtacctgctcagcctttaagttttggcttatgttcaatgtcctcaagagatctttctagatgttcaatccagattgatccccgctatcatctttctcatagaatctggttcttttccttcatagtacttacgctaatttaccattgtagatctattatttgttggctatatttttctgcacttgttcataagctttgtaatgagtcattcatccatccatacctagcgctgttttgttcatccatgcatacctagcactatcctggcacagagtaagtctcaataagtatgtgtagaataaatataattccattttgcatcatgccaggtgacataaaagtgtaaaaaagtagtagatggtatgttcttagtttggtccatggataatcaattattgatgaaaatctacttctatcagggtagctaaatggtttccaagagttttgtctgtatgaggaacctatggataccttgagacaaagaaggaaaaaagtactttgaaatttgcaatcatgctcagcaaagttcttctcacactctccaggggatggaaaactcatctggaggtagaagagagttaagctgtccaagattctttcatgaaacatgttgatttttgtgtgtgtgtatgtgaggtgaaaagaattttagatgtaacacaatgttgagacaaatgttatctgactcaaactgggagaaatcatatttaaaatagcatggtctaaaaaattaaaagaacagggcaatagtttcagggatcatcaaagaaaactgacaccactgagtaaacatcgcaccagagtcccagtgaaagaagcactcagagtaatggaagaaagtcaacataagctgttgtaacaatgtcagcctcctgtgataaccctaaggtcactttcctagtgggaaccaagagacagaaacatatggggatcatggctatcaagtggcaaactggaaagcagcatattaactgtagtatctgccaaggtaaaagataggtcgccctggacccagcccagtgcagacagacagaggaaggattgggatgctaagttgttccattaggtggggacccaggtcaaagcctatgttctttacagaaccatgtcctttgttcacccaccctagactgctacatactggggatcaaggataaaaatgacttctcatgggagtaaatgaaggaacaatgaaagtagtataataattttgtgcttaattacacattcagactgcaggtgctgtagatagctagtgacaagagaatggccatccagaaaagaatgggatacaagtatttgccctcctgcagttcttcatggagtgtagtcagccaagaataaatttaactttactttcttttaatgcctgtccctgggaatttcttatcccataaaacaccaaccttataaaattagagcaccatccctttttcctcgagtggatttctcttctcattttccttttattaattaaaagataatgctctaaactctggcagtaccccttttcactgtgggctcccctggcccactttctgcagtatatcaacttatttatatttatttgtcctaatacctatgttttcaattggtttctattatgcaacacaccacagggaaagagtctagtattaaaatcacactgtgtagtttaattccactttaatgctaggactctggttttaatcaacttattttgatcacagaataattctcagtaataatccaggggtgtcaggcaggccatcagctgagagtaatcaaatgagtctctccacctcttctctctctcttccatatagaatagtgcatttcttccacttcacataaactggagctaaagccaggttccaaattagtctcgtgaaattgtaactgactctctattaccaacttgtaatgggaattaatggagtgaataatctaaaatcatgggtggttctgaattaatgatacttgtcttgagtaacacaatatatgctttttccctccaaaagatgtacatttcttattaatgatgttttcttgatctctaagtagacatcaagaaaaagaagatagtactttttagaatgccaagcaagcgttgtttggggtactttgtaaacactgtcttgtgcaatcactccatgaggaaggtattcttctagtttatggagtaggaagttcagagcagcagaggattgtgggaaaacctctgggctaagagttagggaaaacagttctagatcatcacacaggtattgaaaatgaaggatatgtgttgcggcaatgtagctaagttggaattttgtttttaaaatgttcttttgctgcagttccgagttagtgtgggccacaagagacattttgtgtgggactggaaggcagaagtaaggtgtcagccatgttctttttatgtgggcaagattggtgttgagtatgaggcactggtgtagtgcacaagccttgtcacttttctgccagcctgagttgtgagtgtggggcagtgactgggcctgcagcaccttcagttcctgctggacatcctctgtgtgttcatatctgtgaagaaggatgccagctcttcctgcagatcattccatcatcaaagttgaaagctgggtatggtgagagactgatgtatgtttcagctgtccttataggttccagcctgtccattctgtccttgtttccctgacttcacatctgtcttttcttctctactgctttacatgtgggcttcaggctctagcaccaagacacagaagcagtagcttcatatagactgtttatccagcacccacaattgcgtaacatccaatccttggaataattctttactctttacagctcctatcaggtctgcttctcggatcaaactctgacaatgagcaatcctaggaaatcattcctctcctcacgtaactgtttcttaatcaataattagtccctctggctctatggtgaaaatgaagcatgacacagaattgtgctaagggttttttctttctgttcagataattcacaaaataggcaatttgcattttaataatcataagctaaattaacaggtgatgctgttgtgaaggtaagaatcactattgggaattatatcttggacttcatgatgtgagcaacattttaaggaagtcctcaagccctgggccactgatgtgacgaagcctgtgatgaagatgaaggttgagagcaagacctatggtttctgaatatcctggtttcatgcaggtgtagtgaaagcaataaatccacacatgagtttaacaccttgtttctttcaagtgctttcacagatagtggccacacttgtcaaaatgcttgccttataaacttgctgtgagaaacacattgataatggatctggagacctcaagatgaagctaggcacacagtcatgaattaatggtaattactatgctttacttttgtatgtctctttgactttcgctagctctcttcagtggatcttcagagtaatcttgaaatgctgttaacacccacttaagaggaaataagcacagagtataaaaatggcttgcttgaaggtcatatggctggcaagtggtacaacaaggaccaataatcaaattcactgaaataatgatagagctgataagtatggaacatataagcatgtgtcagatattgcctatgcatatcagttcatttaatcctcacaaataaacctatgagggtaataatagtatcccttttttatagattagggaactgaggttcaaatattaagagaggttaagttatctctatgttgtatcaagttaaacggtaatgaggattaaaatctcgactacagatgatcaagtggctggggggtgggggtgggtatagtgttctaagcctcagcttattaacaatgaaacagtacagtacttatctcaaactgttattctgaggactaaccaagctaagataagtaagctgctgataccatgcctgacatgtactgagcactctttttgttgttaattgtctcactagggcttagtctacgaagacctggtgcctttattgcttaaccagggattagttcactatggtccatgggtcaaatccagcctgaggcctgtttctgtgtggcctatgaggtaagaatgtttttaaattttcaaaggattgtaaaaaacaaagcagaatatgcaacagaggcctgtgtggcttgcaaaccctaaaatcttcactatctggtcttttatagaaaaagtttgccaaaccatagactatccatgctgttttttcaaccttgtgatgcagaactaaaagagacagaaagcctatattgatttagtctaaaaatgcagagctcaacttagagatcttggaagatagaggagtgaatgaaagaagtagaagaaaactgtgtttggtgtttttcagtgaagtgaataagactacatgagatagtagatattctctgccgttgctgttgcacctttctgtaagcaattaaagtataagtaactatagggaagttttttttttaataggggatattgctccctgtcatgccacgtaatctcttaccatttttaggagacattctagtaaagattattataaatttttgaaagtggatttgtgttttctttagggtgctgcactgtatagaaataggccatgaggcagcccaactttattagggttagatatgtatcttctcaaaactatcctgcctgaagcagattttaagtttctaccattcacatctttctatgataaaaatgggtgtttgggagacagcatttatcttcatgaaaaatacacataataatgttacagcgaagtcattgtgctggagagctcagggcagccttccatttggctgaccctgaaggcaacagttaccctgaggttcaaggctactagcctcctttctaggtcaaaaataaggaggggcaagaagcacttaagacagataacctgatagccactctgagatttatcctggttttaacaaaaatatgttaggaagagagtaaagagcccacacatattaaagcaaacaagtgcttccaagactcccatgaaactttaattaatggcacatgtatacatatgtaacaaacctgtacattgtgcacatgtaccctataacttaaagtataatttaaaaaaaagaaaagttataaatgaaaaaaaaaataaaaaacatgaatctcctggaaatgtttcttggttggcccactgcagaggtaaggtgtgtgagaaagacaagcagtgatctgtatcagggagagaggggaggccagagggcatgtgagccaagcctacaaattcatacagggccataaaaagtgcaggtgactctgggactacatacaggaggtgctactgcaaagaagtgaccagcctggggtcatcgaacagagaatgtagaggaggcaagatggataattatggagtcaaagaaaaaaagtccaatgtctaaaccaatggtgagacttcagggggttctttaaatggatgcctgcacaaaaataaataatgagcatgcactatatctacacttatttatggattattttcaatgaataattttattttattcttaaaattcatgtagggagaaggaatcaagttctccatttcagaaattagaaaagtttcaaaaagggaaaggaagtatatccattaagctcctctgatggacattcagggactccgtagacatttccacattccctcatataagcatcgcaagaagccagtttgcttattaccatgtatttaggtgttattgttgtcttttaacatatgaaaaagttgtgactgagaagtttagtcgagatcccacacaattagcaagctctaaagttggaatttgagccctatgtctggctataaccttgacctctttccattatacaatccttccttctctatgtaggattatcctaccttcagaaataaggagacaaaggtttgcacaggaatgaggtttgctgtctccaagtctcttgttctttctagagatcaagctgcttccacttttttcctcaggttatacgatgggcctgtcaacagattgatctccttattgatccctgaatatagtcccattaacctgtggaccactgtacatgttgctccccttgccacagataacctgacctgttatttacatttttcaagtcaaacttgagcatcagctcctcctggaagtcttccctcacccctttttcactgtgacaaccatcatggctccccacggatgccctccagtttataaagatgcctgtcctgtgggttcccataataccttatcatctccctacaagcaaataccacagtacattgtaagagccagattgcatatgtatttcttttattttaccatatattctttgaaggcaggggctgtgctcactgtttccccgggctccagcatggtccctgactactggtggtaagttagtatctgttaaaagaatgagtagatgaaagctttgtttacctttttaataatttttaggctacaattttgaatagtagatcaaagaaatacaaacaggaatgttcattattttattatttatccaatgatactggagtaggagaagcttcagacagagggatttgatatggaacttgcaactcaggtaggaaacaaaagttcacacaaaagggaaatggatacacttagttgcaatgactttaaggaaaaggcagagaaagagacctcccacctgtcctgttgacttttatcagcttttactttgttttgatactgagctaatcaaattagtatctatttccacttctatgtgcaaaaaagcttatttctaagggattaaaacatttcctaaaaatattcagaatagatacttatagtaaaaactaaaacaaaaaaaaaaaaacccttaacacaacacataataagtatctgtctcttatgaggacaaccaccaaaaataacatgcacatcccaaagggctgcttcctcgttacattaatacatcaaaatatctacttatgatgattgatttgtagatgttgatgctgaaaacccatttatcatttgcactgcaatttgcccatctttacagatcataaaaattcattgaattatgcttcttcttatactataatttaatatcttgttttcagcaccagaataaatccccataagtaataatttccctatgttaccctttagcagtcagtcccaatcaatgcattttatatacacacatgcatatgaaaagttaatgaaacaagtttctcacttcataatttcttaactggaacccaaaccaaaagacacagagagaagtacctacctatttaggaatcagaacaacaaaattacccagttaataagaaagtcagctgcatatttctaaaataagtataacatcttgctcattccaccaaaactgtaatttataaccaacactgtggaaaagacacatgtatgtattttcttagaagttcacagtagagatttttagtacagccattctacgccttagacactaacaagacaattaataaaatgatgtaacactggagatctggaataaatgtatgacttttgcattattagtacacatgacattatcttaccttattttcacatcatttctacaaaatgctctaagtattttaataattaatatgtactttttcaatcttttagagaaagtgaggcatggagaagttcagataatgcctcaaaaatatgaatgagatagtgaaaacgcaaaatgaaaataagataacagaccaatcccatcctctaatgcaaaactctctatttttattgtaaaattatgaaaatccccaattatttttagcctctgaagaaatttgctaattgttctcagacatccaaagctaggtcaagaacaagactctttttccccctcaagtcataaacttgtctaaaataaagtaaaacaaagacttaagaaataagaccctcaagtactaaagtgcttttgaacttcaatcgtatattagcaagttattctgaagtatataaccaagatcctggatctccaaaaatctcaagttgtgaatacctctatagcacatcatttctcccataaaatgtaggaaaatacaaaataataattcagtgaaccctttaggaccttaatgattctacaaatacattaataaaatcatttaaaaatctataaaaataaattctgcttcccaaataaacacaacaccccattatgcttccacattactgttgtgacattattgtgaagttactggaatctttaaagaaacttttaatctccattaattattgatctctaaacaatgaataatggatgacttccaaagcttattgagatgaagaaggtgggcagtccacctgggctactccctggccaaagagattggccagatcacactgtgtgtttccagtctatgcctcagtggtattatactcatcacacaatatgactctttagggtactttgtcaataggaaacaccatgagtgttgcatactgcctggaagagctccctttaactggtttggagaacagctgtcaaagccatttcatggattgacaattctttaccagactttcatggtccaggggagctattggggttttgtctgctatgttgatgtaatgataaacttttcaaaaagatccttttacatcctcacaaattctgtttcagagaactttctctaaaatgtattgatctcttggctctattgacttataataattagtcatatgataaacaaccagcggctggagaatggtgggccataaaccagatttgctttcaacatctggtcatggaaggagaagagtgacacttgaagaggtaagaaaggtgagggtgagctgacttaaaggttcaaagcaaaaagatgaaaaaaagactgcctttatgtataaaaatttccatcacacagagagcgtcctttgttcttaggggtgatgccatattgcaacttttatcccatgtaattggtaaggtaatgagatggccaaagagagatgatgctgaaggcacatactataaaatcgctgatgaacagagaccacagattttggtctctgtctctgtacaaggaagtagcacctgatattatttctattgactgctccagtattacactagcagttcctacagaaggaagtatgaactcatgatgggcagattactctattctgtccctttgttcccaactagctatactgaaaaaagaaaatggggtagaaaattataaaatatttaaataaaattggggctaaatatggggctaaaattataaaatatcacaataaaaatttcataaaatttggaatattaaaatgctaatgccatgtgcttctactcagatttagcaaatgttaacacttaccattctttcaacaaatctctctttgtgagaaaaaggcaaatgtagtggaagatcaattttcatcacttttaagcatttttttccctctttccctagaggtaatcaaggtcccaaagctgttttatatcctttctgattgttgtttgtatatttttatcacctatctgcatctccacataacacatagcatttgagttttaaaaagttttacataaatgtaatcatatagtatttatgctgcaatttgctttttcacacaagattggttgagatttttcagtgttgataaggaaaaatctagctcattcaagttcaataatatattcctgtataaatacatcttctaaaaaatgtcattgtgattcttggaccctcttggaattttaattagaatattactaagttgattaatctgagattaatgtcttcattatattaactttagccagtcgtgcacattgtgattctttctctttcatccaatcttttagatccttgaattgcacgttataattttttgattgttgttaaagccattttacacatattatgtacatagttagaggttccttgtagtcattattatcaatggaaatttttttcctattatattctctattttgttatggctgatatgtaaaaacactctcaagtttttatattgatctgatgtgcaataaaccttttaaacacccttctaacagtttggctggaaattcattttcaaatatctatataatcatatcatattcaaatagtgacaattttttttcttcttttccaatcaacctatagtttatattcttctcttttctttccagtaacaaatttaagtgctagcagtagccttgaatatcttatatcttactaaatacctgtctttaatggaaaaatttcttacatttcatccataagtaaggtgtttgctagaatgttggtggatactcttcaatagattaagagtatttgatccttaggtcgataagaatttttattatgaataatgctaaaatttagaaatattttttcctacttctattgaagtgattgtgtgattgttttctttaatcaatgtacagaattatactgagagatttttatgaatttttatgatagtggcctatggtcatattcctggaagaaaaagacttaaaaaatagttcaatgtatttataatactctgttggatttaatttgctgatgttttatttacaattttgtatatatgatcacacatgagaatagcttatacttttttttcctcttctgtttttatctcctcttgatgttaagactatattagcctcataaaatgaattgggtagcattctttatttttctattctctgaaacagtttggactatatatgtaccatcacttactcataaatccatttatacctatagttttctaagaaagacattttataatagctactggttcgttttggtttcaaactaagttttcaagcaactttaataatttaatttattaagaaaactatccatctcttaatattttaaatatttggtgtaataaaatgactgatcaaaatagtaccatagttttatctttccactgtatctacagttgcattattttttcattactcattcagtctctcttttttcttaatcagtcttgctaatttattctttaatacaatcagttttatttttcaaagggccagttttacttgtattgatcatctcttctttgttttctatttcattattgcttctttccagaggattcctttgcaaacaaagttctaaaccatttgaggaaaactattacaaagaaagtcgataaaatcaacaattaagatttgactatactccaaatagaataaagatcatagaggaaactgaaagtaaattttaagtgagatggttcagaatacatgcctagataaaaacataagaactatttttattgagaagataacgtattagacaacaatcactagggaatggggtgcgtaaagtatttaatgtataattgtcttttggagggaacagcataggaaaactaaataatttacatattggttaagtatgttaatttaatggagtactctgctagagcttttctaatttcaattttttgtttttttctattactgctatgtgtttgaatcagaagaagggcaatgtcatcttgacaacttacatattgtaagttatagatcctccagtatctttcttttacttaggaaactttgaaagataacctcagtctcaagtgtcatgtagatcttagatacataaagttctttgaacttgctcaattaaaaaaatggaactgaaacatgaatgtattgggcttcctatccaagcttattttttgatcctgcttttgaatacctttccctctttccaaacagaagagctgatgctgctcttgagggcttggcatttttctgcctttctttgtttaaggtttcacctttccctcagttcctcacctaaatactagaccatgagcttctagaggataggaagtgcttcttatctttttgactttggtgcctagtacattgcctggcacagagtactgaagagttatttctctaatagttacaagtgcttccttttgccatttatcttagtctatctcatctctatagatatgaacatagcccttaaagacactacaagtctaaatctcactccttcaagagtcagcctccctctattgtaaagcttttctttatagtgacaactggaaataattcaattttgaaagtttttttttaacgtgtctcttttatgccacttattgttttctataccataagacagtgatttatggacatagattttcttttttacaggactgtaaaccctctaagaccaggatccatctaatttttgttctatacaaagcaaaacaatttataaatatttgatgaataaatactttataacataaaggaaatgatcatgtttgaatttttcacttgtttgccttttaattaatcattattttcaccaggccagtaagaagattgctgaactatggtgctgatgtgtcacctggagagcagatgtcctatgggcatgaaatgttgccttacttccttttaacaagaatcaacccctcaacgttggctttgtagcaaggctacataaaattaccaggcttttagaatacctctaaagcaaaggtcaattataatttgttggataatttctcttctaaatttataattctgagatgtttaattttagagtgataaaaattatgattcaaaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctatatatccaacaaaggacgagtatccaaaatctaaaaagaactcaaatcagcaagaaaaaataaagcaatcctatcaaaaagtgggctaaggacatgaatagactattctcaaaatcagatatataaatggccaagaagcatatggaaaaatgctccacatcactaaatatcagggaaatacaaatcaaaaccacaatgcaataccaccccactcctgctagaatggccataataaaaaaattaaaaaataatagatgttggcatggatgctgtgaaaagggaacacttttacaccgttggtgggaatgtaaacttgtacaaccactatggaaaacagtgtggcgattacttaaagaactaaaagtagatctactgtttaatccatcaatcccacttctcggtatctacctagaggaaaagagttattatagaaaaaagatacttgtgcacacatgtttacagcagcacaatttgcaattgcaaaaatatggaactaacccaaatgcccatcaatcaatgagtggataaagaaaatgtgctgtgtgtgtgtatgtgtatgtacatacacatacaccatggaatactactcagccataaaaaggaattaaataatggcattcacagcaacctggatggaagtggagattatcaatctaaggggagtaacctaggaaaggaaaaccaaacatagtatgttctcactcatttgtgagaactaacctatgaggacacaaaggcatagaagatacattggactttggggactgggggaaaatgtgggggatggtgagggataaaagactgcacattgggtacagtttacactacttgggtgatgggtacaccaaaatcccagaaatcaccactaaataacttaaagaatgcctgggattttttatattttgttcaacatgaacttattaatattatttatattagaaaaatgcatgttagtgctgtttcagttagactcagaaaagctgatgtaatccaatcaaaaacttaaatccattctatcagtagatgtatcattaaggtttaaattcaatgagcagggaatgaagtcaagtttcagcaaatttactgtagaaaatgatgataagaagtgtgcaaagtggaatgctacaaacacacaagcagttggcgggggcgggggagggggcacagagacgggatcctgtcctgagtcagctaattaccaacctggggaagttacttagcccttctgagccttactttctatgcctaaaaactgggaattgtattgtggatttgaagaatgtttgttaagaatactgaaatgtatgtacatatgctcctaataccatatttggagcctatcatttatgttataatttatgatcctttatcataatcatttattattatgaggatgatgatgaaaattttccatagtcagcaatcctgggcttcatagccctatgatcagacttgcaaattagaacttgagtttctgctgcgatcaggtaaatgaagtttgtcctgagggtcatgatcatgacagtatgctctggtgcaaataattagggcaatttaaaaaattacattctcaatggtttgggcattaatcttttctaaataatcataataaagtggaatagtccatcttaagaagaagttatagccaaataattttgttcaattatattaaccaatatataaaacatgagatgctttattaaagcaaatgagaaaaaaaatctactttgccaaaagaacatttggatttttttctttactatataccaatgctctgtaacatgggagagctatttcctactttataatgaaaatgtatgtgaaatacacatgcaagacaaggacggcatgtatgataagtgatatgacccaggaagaactacaggagatcatgatacaaacaagggtctatgaactggtggggaagagagagtcataaagaagacagggaccagaaatacatgctaatggagaaatgacttcagcatcatagaagaaataagtaaaaactcagaaatgagaattgtttttcccaggtaactagtctcaagggtatggtggtgaacacagttgtgttttaatgcaatccacagaaaaaatggcagaatagtctgtgaagccaaacagcagtgaaggtgagtgcaaatctgggatgaataagggagggattagccaaggagaccttccacctgggaccccaatatgccatgaactgagctggttatggtagcttgccatttattaggtttaatattaatactaagcaatttactacaatgtctcataatctttacaatgattttgtaatgattatcttgatattacagatgaagaaactgaggggaaaaagatgttaacttttgctgattctttcaaaatctctaattcttacaacaaccttagttcagcattattaaccttattttcaggtaagaaactgaaatttggagacactgagtcacttaacaatggccacacagctgataggtaggagaatcaaagaatgaatatggatctgtgagaaaacacagaatcacatacatgcatctatgaggacttgaggtaacacactgtctcctattatttgaaatggtagaagctgagtctaggtcacatggttatggaatatctattatatgcaaaggtcaaagtttatagaattttagaggtgaaagggcccttagatatcttttattgcaatatgcttactttatacataaggaaatactccaagaaatgtaaatggttcaaagttaaactatgttcagtacgttcagtgattattaatataaagaatggaatcatacacacagaagattctgccccacctacatgggtaattttgtgatgccaaatttaacattttctaattaattgtctacaatttttcaatatcaaataattctctttgtaaaagtagaaaactggagaatgataagtttgaacataaaaaaggaaatggaaatgtgttaattataaaaaaaaaaatgtcctattttaaagttaggtggctgttagcattttttttctgctcaggcttgaccctgagagggcttcctctgctgtagatagggagttaggaaaactattcctatctaaaaatgaaaataccaatgtagcttacttgctggccaaggtgtacatatagacatcaatgtcatgtaacaaattttaacttaaatcctgcaatgagtataagaaaatcctaaattgataaagcaaccattctctgggaaccaggaaaagcaaaaacaaaattgctctatagaaatacttttacaaccatcctcacaaggaacttccacagaaaaagagatatccattgaataacagattcctaaccaaaattagaaacaacaggaggaaataaatcaatgtaggagtagtcagaagctaaaattaaattgataatgtatgctgtaagaatcaaaaataatatatactcttgaaaaagacaacatatttataataaaaatgtaacagaagagatagaaatcacaatcataatgaaagaacaagacctcctatgggaaaaagaaaaatcagatttaaaaagaaaccagaatagactgataaaaatgaaaattataagaataaaattaaaatgcagtgggtgtattaaacaacagctatgattagctaaagagggcattagggaattggaaaacagatgtgaagaagccacatagaattcaacacacagaaacatatagaaaaatttaaaagatgaagagatatggaacatagaaagaaatagattaccatccaagaaacaacttgttagagtatatacttgtggcttgttagtcttcccttatgtcttcgatgatggtatttaattgacttcctgttttgtttttgtgatgtctgagttacttacatattcagaagtagattacagtcatcccacattatccacaggggactggtttcagaaccccactctgataccaaaatctgtagttgctcaagtcctttatataaaataacgtagtatagttgaccctccatagccatagtttccccattcatggagcgcttactgtgctacactgatccaattttgattctgttaattcgtgtaagcatagtacaagtttaactatttattaagtgaatataaatagaactctaggaaactagaggaagcaaagataaatcatgacaaacaaaaatatgatagaaagtggtggaagtatgaccaaatataccagtaatcaggatgaaaattggaattaaacttccatattaaaaataatatcaggtaccatttaaaaataaccttataatgaaaaattataaattcatatgaatttatgaatgaaaaattataaattcttatgaaagaggaaagcaccaagacaagtgtagaaatataaggaatgatgactaatcatgccagctgacatcaggacccatacaagtataagttatagacaactagaccagtggcagaagggaaagcctagaatcacatgcattatgtgcaaagttggaatacgaagaacgtggcattaaaattaatatggacttaagaataggctatttaacaaattttggtaattcaactggctgtgggaaataattggatccctacttcatattaatacaattcaagaatttcatacagataaaataccaaaatgtgaaaagaaaagttataaaatttagagagaagtataatatttttataatcttagcacagaggaggattaaggaaataaggtacaaaatctatcagctatcatggaaaagttagttaagtagataaatgtgacatattaacattttaaatcgtctgtataagcaaagttaaatgcctgagactgggagaagatatttgctgggcacataagtgatataatattagtatccagaactctgtcactttgataaaaaaataggcaaataatataaactaaaaactcacagtagaagatacccaagcaagtaactagatgctcattttcacttgtgattcagagaaatgcgtatttgaaaaacaaagatatctattcacatcagcaaaatcttgcaattaattgggcaaatatgtcaaagaagaaaatggatgaataattgtggtacatttatacaatataatccttaagatcaaataaataaactatacctacatatatgaacatgaatatatttcaaaatataattaaaaaagcagtttgcaaaggacacatatagtatgtgcaataattatgaacacatgtatgtaccaagagtaaaaggtgatgtactaacgtcagtgtagtgatcccttctagtgaccaagaaaacacagaacacaaaaaacaaacaacaaactggaatgaagaagtatatagacgtataatgacactttttctaagaacaaaacctctgagacaatacttgattattttttgttgctgccatttgtctttggaactgacatcatgccggggttgggtcatgaagctgatgacttgatgtaagttgcatggatgttgttagtttcctcttcaattgccttttagctccttaaaagcaaatggaatttgtccccaatagtatattttcaatgactgatacaatttataaaatgtgagttgtcaacaaggagcatgatgaggagaacactgaaaatatgaacaaatcctaagaaagttaatagctagatcttgaatgaacttgagaggaagttatccaaattgaaaactaaggcttaaggaggaaggcaattgccagaggccaagtgactgatgagaagtaaggatttacaagccacaggtctccagctatttcttctaagcctgtggtacataaagttctttgtgtcagagacttccttgagagtctgaaggaagcttaaagtctcaatttcaccatttcttcaagaaatgagcacatatttgcaaaatttgcatataatttctgaagcctaaggtctgaaaccttacctaagaacatccactgttaagaatttctgtggacaagtcctaggctacatgttgttggcataggatctaattgggaatgctgctttttatttaaacaaatcagatattctttcaggtcaaccacgttggatgtggggaggatcatttttagaatgggagctcctcagagatggtagtttccaggtgagtggaagtagacatcagagttccaggtgagtagaggtagacattggagtctacttctgctcaccttggagtagacattggagaagggtgggatggatggaaaaggagaatcctttgggagaggcattggagtttgctgccatagcttgatctaagagctttgacaggctggggctttcagacaccaggattcaaagcagctcagagcatctccatgcaaagcatccagagtgctttgtagccatcctttcccataatacaggcaatctttctgttcttaattgcacaatttgtcctaagaaattagaagaaacaaagaaaagccttacaactacatgagagagattaactttttaaggaaggaccacacccaccatttcattaactctatatttccagtgcattgcagattgctgggaatttcaatcaccactcggtaaatgtattcattgcattgattgcaaaaagctaatttgatttgctttggatgtttctcctcctccaaatctcatgttgaaatgtgacctccaatgttggggtctagtgggaggtgtttgagtcatgggggtggatcctcataaatgtcttggtactgtcctcaaggtaatgagtgagttctcactctgagtgcatgtgagacctgactgtttaaaagaccctggggccagatgtggtggctcaaacttgtaatctcagaactttgagaggctgaggtggatagatcactttaggtcagaggttcaagactagcctggctaacatagtgaaaccctgtctctactaaaaatacaaaaattatccaagtgtggtggcacatgcctgtaatcccagctactcaggaggctgaggtgggagacttgcttgaaaccagtaggtggaggttgcagtgagccgatactgtgccactgccctccagcctaggtgatagaatgaggctccatctcaaaataaataaattaattaaaataaaataacctggcactttcttccttgctctcttgctccctttctcaccatttgaccagcttctcctttgtcttccaacatgattggaagattcttgaggctctcgctagaagcagatgctggtgagatgctttctgtacattccgcagaactgtgagcaaaataaacctcttttctttataaattacccaatttcaaatattcctttatagccatgcaaagcagactaccacagaaaattcatactgtggtatggagcactgctataaagatacctgaaaatgtggaagcagctttgggacttggtaactgacaaatgttggaagagtttgaatgtctcagaggaaggcaggaagaaagatgaaggaaagtttggaaattcctagagacttgttaagtggttgtgaccaaaatgctgatagaaacattggcagtgaaggccaggctaattaagtctcatatgaaaatgaggaagttattgggatctggaataaagtttacccatgttgtgtgctagcaaataacttagctgcactgtgtccatgtcctagggatccgtggaagtttgaacttaagagggatgacttagggtatctggtagaagaaaatttctaagcagtagtattgaagatgtggcatggctgcttctaacagcctacagttaattagacgcacatgcaaaggcataacttaaagtttgaatttacaataaaaaggactgcagggtgtaaaaatctggaaaatttacagcctggccacatagtagagaaggaaagaccattttcaggagaatagaccaagcaggctgtggagcaaccacttgctagagacattcacatgactaaatggtagtcatgcactcgtagccaagacaacgggataaagacctcaaaggcatttcacaagtttctgaggcaggtctcccaccacaggcccagaggcttggaaaggaagaatggtttcatgagccagaactggggcattgctccccacttcctggctgcggctcaaggcatcccaggtacaactccagccagatgcttcagatagcacaagttgtaagccttttcagcttccacatagtgcaaagcctttaggccctcagaacccaagagtgaaggaggcttggcagcttccacccagatttcagaggatgtatgggaaagcctgggtactcagacagaagcctgcttcagaggaagagccctcagaaagagcctttgctagggcagtatagaggggaagtgtggggttggagcccccatacaaagtccccaccagcacactgcctagtggagctgtaggaagggtcatgctgcccttcagaccaaataatggtagagccactgacagcttatgccctcagtctgaaaaagccacaggcaatagactccaacctgtgagagcagccgtgggggctgtaccctgcaaagccatagggacaggccagcccaaagtcttaggaggccatccctcatacccatgttcccaggatgcaagaagcagagccaaaggagattatggtggagatttaagatttaatgtctgctctgctgtgtttcagacttgcatggggcttgttactcctctcttttggccaatttatcccttttgaaatagaaatgtttactcaatgcctgtaccaccattatatctaggaaataaataacttatttttgatttgacaatctcgtaggtagaagaagcttgccttgagtgtcagatgagactttagacttttgagtgatgctggaatgagttaagattttggaggactattgggaaaggatgattgtattttggaatgtgagatgaacatgaaatttggaggaccagggaagaagtaatatggtatggatattttgccatttccaaatctcatgttcaaatgtgacttccagtattacaggtggacctagtgggaggtgtttgggtcacgggggtagatccctcatgaatggcttggtgctgtccccatgataatgagtgagttctcactctatgagttcacatgatatctggttgtttaaaagagaccgacactccttcctctatctcttgcttgctctctcaccatgtgacatgcttgctcccactttccttccaccatgattggaagcttctgggggccatcaccacaaggagattctaatgccatgcttcctgtacacccagcagagctatgagacaaataaacctcttttctttataaattacaaaattccaggtgttcctttatagcagcacaaaacagacacacataattctaggttctttttacaaacaccaagattcagacattttagtggtttaaaattagggtaaagagtctcattgccattattctctttaatgaacaaaacgttagttgtgaaattatatattttaatgaaatatagtgtagccatttacattaatttgtacattgtaaacatgttaatgtttctctgtattgtctcttccaccaaaaatgttatctttgactgattcaccctctccgaatactgggagagaagggttattttggtttggttttaatttgtcaatcccacaagcagttttcagcagatagaaggtatttggagattttcttacatgaaacaatccaagcatacactttataattttttttactatgtttaaattgatgtatacaacacatgcagaaaagtacacagatgataagtatataatctgattcatttctacaaagtaaatacatctatgtgtttgccaccaaaaatctaggtcctacactaaaaaatagaacattaccagcatcccagaagccccagatcaaagtaggcatatgcaagaaatattttgtaatttccaatgtaattgcttctttgatccatgggttatttagaaatacgttgcctaattttccaacatttgggaatacatttgggaatttcctagttacattcctgttatttacttacagtgtaatatcactgtgaagagatatatatacatatatatatgtatatgtatatatacaatctgctttgtgttttctggattaaaaaaagtttgttatatcagttgttgagaattgttacagtctcctactataattatagattgctctattcttcacttagttttgtcaatttttgctttactgaaattaagtctatgatttaaggtgaatacaaatttagaactgttatatctttttagtggattgacccttttatcattataaaatatcctgtttaccgctggtaatattttttgccttaaatctacattacctcatattaaacaatttggatgatatattttcagatatttttggcatttcctgaacaatgcaagcttcttagaagcttcaaatccaatgataccctctccatattttatatcattgttttgggggggtggtattttaattctgcataaattttaaactcaaaacaatattagtagcatcatattttaatatcactttatagggtcaatattaatttatatgtctactttttcctcattactttctgaattttcttgcttcaatctaggatcatttttctttgcctaaagaattcacttgtattttgttttctgcaaatccgtcattttttgtctaaaaatgtctttattttgtctttacactgaaaggataattttacttggtatagaatttcaaaattgctgtaatttgctttaattcttaaaaaatgtcactccatttattctgccttccataacttttattcaacttctattttagattcagggggtacataagtaggtttgttacatggatatattgcatgatgctgatgtttggggcatgattgattccatcacccaggtagtaaacatagtacccaataaatagtttttcaacccttgccccatccttctttaccccctccagtgtccctagttctattgttgccatctttatgcccatgtgtacctaatgtttagctaccatgtatgtgtacatgtagtatttgggtttctgcttttgtgttagtttgcttagtataatggcctccagcatcactcattgttgctgcaaaagacaggattttgttctttttttattggtgtagagttttacatggtttgtatgtaccacattttatttatccagtctaccattgatgggtatcgaggttgattccatataacaaacctactcatgtaccccctgaatctaaaataaaagttgaataaaagttatggaaggcagaataaatggaatggcattttttaagaattaaagcgaatcacagaaattttgaaattctacaccaatcatgggcattgaggttgattccatgtctttgccattttgaataccactccaatgaacatctgagtataggtttctttttgggaaaaatgatttattttcctttggagatatacccagcaatgggattgcttggttgaatagtagttccatctttagtcctttgagaaatcttcaaactgctttccacagtagttgaactaatttatattcccaccaacagtgtataagcattctcttatctctgcagccttgccaatatctgttatttttctttttttaatagccattctgacttgagatgatatctcattgtaactttgatttgcatttctctgataattagtaatgttgtatgtcttcttttcagaactgaacaaaataaagatctatacaggaaaaccaaagtttattttttgtaaggataaaaaagatcaatagactactagctagattaacaaaggaaaaaagggagaagattcaaataagcactatcagaaacaacaaagatgacattacaaccaatcccacagaaacacaaaagttactcagagattattatgaacacctctatgcacacaaacagaaaatctagagaaaatggataaattcccaggaatgcacaaccttcaaatattcaatcaggaagaaatagaaaccctgaacagaacaataacatgtgccagaattgaatcagtcattttaaaagactaccaaccaaaaaaggcccaggaccaggtggattcacagccaaattctaccagacatatgaagaagagctggtaccaatccttactgaaactattctagaaaataaaggaggaggactgcttctcagccctttggctaagatcaagtgaaaatcaaggaggagagactcctccctaattcatttgatgaaatcagcatcagctcaacattaaagcccagcaaagacatgataaaaaaagaaaactacaaactactatccctgaagaacacagatatgaaaatcctcaacaaatactagcaagctgaaatccagcatcacatcaaagtgttaattcaccacaatcaagcaggtgttattcctgggatgcaaggttggttcaacatccataaatcagtaaatgtgattcacgacatgaacagaattaaaaacataaatcatatgatcatcttgatagacacagaaagatttcagtaaaatccaacatcccttcatgataaaaaccctcaacaaagtaggcattgaaggaatgtatctcaaaattattggcaccatctgtgacaaacccacagccaacaccataatgagtgggtgaaagctagaacaattcccctattctccttaataactagaacaagacaaggatgccattctaaccactcctattctactgagtactagaactcctagccagacaaatcaggcaagagaaagaaataaaatgcatccaaataggaaaaaaagtcaaattatctttctttgctgatgacatgattttatatctagacaaccctaaagactccatttaaaggctcctaaaactgataaacaacttcaataaagtttcaagatacaaaataaaagtacaaaaatcagtactatttctatacactgataatattcaacctgagagccaaattaagaacaaaatcctatttacaatagcaacaacaacaaaaaaatacctaggaatacatctagccaagggggtgaaaattttctgcaaggagaactaccaaacactgctgaaagaaatcaaagatgacacaaacaaatggagaaacattccatgctcatatattggaagaatcaatatcattaaaatgaatatactgcccaaagcaatctacagatttgatgttattccttgcaaactgccaatgtcttttttcacagaattggaaatatcaatcctaaaattcatatggaacttgaaaagagcccaaatggctaaacgatcctaagcaaaaataaaagtcagacttcatcacattacccaacttcaaactatataacaaggctacagtaaccaaaacagcaatggtaccagtataaaaacaggctcatacaccaatggaacaaaatagagagcccagaaataaacccatatccctacaaccaatcaaccaaccaactgatctttgacaaagtcaacaaaaataagcaatgaggaaaggactttctattcaataaatggtgctgggataactggctgtgcatatgcagaatgaaactaaacctctatctttcactgtaaacaaaaataaactcaagatggattaaagatttaaatgtaagacctaaaactataaaaatcctagaagaaaacctaagaaataccctaatggacatggccttagcaaagaattttgactaagtcctcaagaacaattgcaacaaaaaaacctccaacatttacaaatgggatgtgattcaactaatgagtttctgcacagcaaaagaaactgtcaacaaagtaaacagacagcttacagaatggcaaaaaaaaaaacttgcaaagtatgcatgcaacaaaggcctactatccagaatgtagacagaacttaaacaatccaacaagcaaaaaaaatgaccccattaaaaagtgggcaacagacataatttgtgttgaatgaagtctgcattttatgtctttttctttaaaggttaaatgtctcttttttcttctgtctatatttaaaatttttacttttatcttttaacagttttactatgttttacctatgtgtagttttattttattttattcttgttggggtttgtcaagtttattgtttctgtgggttagtgtttatcagttttagaaaattctcaaccattatctcagcgaacatgactcctaccttattctgcacttcccttctatctgggctcttggctgcttagggcttcataacctcagttactctaaaatcccttctgggatatttttaaatcattttatgcacattatctggttctctgcaaaaggatcaatctgatctaagctaatcctccatagccagaaggagaacatccccgtttgaggtgatacttcttatactgtcataatcctagccatagactgaacacataatatacttatttttacttagacatagtcacatatgtgaaatgtgagccaaatttaagttatgtaaaaagataataatgttgagcctattaagtaacattaagatctgcagtcctagtcaccagttgccctaagtgagagtactagggcaatgtgacctcactataaacccgtgcatgcttgaggggctgccaaatcacaagctggagtcagtggggggtgggagggggtaaagctactgccagaaatcccaagccaaagggaagcagaggaagggagccaggtgaaggaagtagcagcgtggcatattgtgtattggaagatatccagaagcactttggggccctcacaggctacttcctcatccacagatgatacccaggcctccctctaaaagcagataactttttgtgtctaagcttcagatttcttaaaatgataatcatgaataattatattacaggctggtaatgactgtaaataataaatatgcaaagtgcttagaatagtgtcttattcagggtaattgcttaataagtcagctatgataatggtgatagtgataataattattgtgtttaagatattgatgattgtgatgatggtcataaagtaaaaatgattatcattaccatgaagaaagaggatatcatatatatagtatatgtatatatacactcccccaaaaagtcagctatgacatgacagaatgctagacttccccttttaccttgaccttaatatacagtaagtatgtatgcttgaaccatcccaaaaccttccctcccaacccctggtccatggaaaaaaatgtcttaaatatacatacatactgtatattaaggtcaaggtaaaaagggaagtctgatatttactgcttttaaatatgttttctactgtaaagtggtcatgcttctgagcctctatctgattgaactggctgagttctatatcagggcaccagtgccctaaacagggtctctgtgacataggacatgcctccacctgggttctactccactttccctcatacaagtaatgtcaaggagagaataaagctaacttattgtcatagagcttgaagaaggacttcacactagtttttatagctcagagtttcaggatgattaataagcaaggactccaaggagaaacagcacatacttcagaagagacacattcctcattgtggctcttgctggaaaatattgataatagaaagcaattttcccaaggttcattcacataggactagatggattttttgcttcaagttcactgcatttttagaagggaataattaaaaaaaaatctaagtgccacttaaaccaaatgggtaaagcacctagatagaaaatgataaaatcaggacactgccatttctattcatgaatgccttttctgtcttcatttaacttaagatatttttgattgtagagaagtaaaacatgcataaaataccagccttttcagcaagtgataggcaactttgttgatacaaatggatttgatgattacttttcaagctgtagataaagacagaattgatggtgacagggaagagatggaacccatatgggaaaggctgaggaaataaacttgtccaggatgtatttctatgcttttttatgtacaaagaaatatacaaacatagaaatatatatatacacatagtatatatgtataatgtgtatattacatataaatatatatatctgtgtgtacacatacatgtacacacagaaggaaaatatcttttaaattgagagaagaataacagttttcccctaatctggctgaggttaagattctagcaaatatgggctcccattcataagtaaacttgtcccagtgaagacagaggaaattgtctaagaaagccaaagggtcttccactgaggtggaacagagtgacatgggttaggggccccatgcagctgaggattcttcatcaaagtgagttgtgcaataaatgtgcactagagtaaaattacgtaagcctcaaagtctcctctgaaccaccactgtctttccagacttgaggaatctcactttcctctctcatacaactcccatggttctctactcaatagcatctactatgtccctttttttctagtttaatcctcccagagacctagagttttcaaagacagaggcagatgatgggagaaaacgtcctagagcagcggttcccaactgtattggtctgttctcatgctgctaacaaagacatacccaggactgggtaatttataaaggaaagaggtttcattgagtcatagtttagcatggctggggaggcctcagaaaactaacaatcatggcagaaggggaagcaaacagatccttcttcatgtggtagcaacaaggagaagtgccaaacaagagggggaaaagccctttataaaaccctgagatttcaagagagctcactattatgagaacagcagcatgggggtaacgacccctatgattcaattacctctcatgggctccttcccacaacatatggggattatgggaactacaattcaataggagatttgggcggggacacagccaaaccatatcatcaacatttctggcacgaggaaccagttttgtggaagacaatatttctgtggacctggggtgggggttggggcaaaggtttcaggatgattcaagtgcatcacatttattgtgtgcttgatttctattattacattgtaatatttaaataattatacaacctcaccataatgtagaatcaatgggagtcctgagtttgttttcctggaactagatggtcccatctaggggcgatgggagatagtgacaggtcatcaggcattagattatcataaggagcatgcaacctagatccctcacatgtgcagttcacaatagggtttgacctcctgtgagaatctaatgcagctactgatcaagaagagccagagctcaggtggtaatgtgagtcatggggagtggctgtaaatgcagatgaagcttccctcactcacctgttgctgctcacttcctgctgtgcggcccagttcctaacaggcctctgactggtatgggggtagagggtgggggtgttggagacccctctcctagaggaaaggaaatgcaacagactggctttcttcttggaatcccctcatcagttctcagttttctcatctataataagaggagtttgaactataattatctgaagtctgccccagctggttactctgggagtctaggatctaaaattggggaaagacgacatgcacatagaaattacattttaaaaatctatatagtgtaggaaagaaggaagccctgaggctgaagcagtgactatgcaactctccttacagaagccatgttcaggagacctcattcccttttgcagaccctcattcacttttttcccctcacccctactcagaatcagagctaatttttcttaggaaagaaactctttccagaagtgaggcagatacaatgctttgcatttttcagatgagaaagctgtgagtcacagttgagtaatttgtccacagtgacacagtgtatctaataagtggtagagagaaacaagtaggagacagagacagtcatttgacagaatctcccttcccttgaacccttgtgtcaagagcttctgggatcctactttcaacactggtaggctggactgcttttggctgaggtgagttctctctaaagccatcttgctgaccatcactttatattggctgacctctcagtttcctctctgtaaatacaagcagcaatatctgagtccatgcctcccagggatagtaagataaatgagataataaaggtgagaaccaaatgagctcctcttaatgatggtgttaaaaaccccatgaggtactgtgatgttattaacaaaatgcagaggctgcagagttacatttggccaaattcttacacctctcaattttttagcaaggagacatagatatgaaatcagtattcccaatagtgaaactgactacaagtgtgttctcatttttaaacaaacctattctatgcaaatccaattaatagaaaaagtataccaatcaaggatctatacatatagctatctttcacaaaactattctagttttccttattaaaaaacttcaaaacacttcatgctttgtggcatttcagtgaaattggaattgtaaaataatgatttactgaaaaccttttaaaggtactgatctggcatgaagtgaggtacgactgaagtttctagacaaccatttgagattttggctgtggagccctcccaaaagaagattctaccagccagttgcatcacttgcaaatattggaggccgttgctctggaaaagcaactaaaaataatacctgggtgtggacaaaataagaagggagccatactcagctatgagccagtgtattgcaaagggccagtgctggtcaaaagcagtggggccatcatcttgatttagacatactgtccacttctctaatgcaaacccacaaaattgttgactcttagagtgcccacaaagcttctgctgtgacgataggacttttagggccatgaagaagctaacactaacttttacatttcaatttttaccttttcccacatagcttacgctaaaactcttcccaacttgtggcctggagaatgtatttttctggcattacattccctttccaacattattcctgtccctcaacctgttcagtaatcttatctaaaactactggataattcctttgagggtgctatcatagcccaaatatgtcaaggtctgtttttcactagtaaacagtgaacatcttcagttttaaatgataagttaattctacaacttaattgagcccatttatgtttattcattgctgaagttcctcttagatcttgccttctctcacatcttctctataacccaagaaggaacccacctagatctcctggaccccctcttgcctgatttaggtagatcatcataggagatgaaaaattatcatctcaaatttaagttttcaagagatggtatcaaaacacgcttttgtcaacaagcccaatcatattcccacaacttttgagtgctcttcctgattctagagcaaacacactgatttagatagagcaccatgtttctgaaccttgaataatcctgttcagattgaagcaggggtgtattaatagagcgcaggtcttggagttaaaccacacccgccctcacccccaaccccaccaccccacaacaggcttaggaaggttgctcaacctctcaaggcgaaggcgtttgctgtttctcatctgtaaaacaccaaagattgccatccccatcactgttgtggaagatcagcgagacataaagtgcctgtcaggatgtttggccaatagtggtacctgattcagtcattcagtgactttcacagtcaccttgagcttgactctctcaagaaaagaaaagaaattaagaagcatgtgagccattgaaccttgaccacaaatattctaagaaacttataactccttagccatatgtttcatttcaaatccaagtatgaaaaaagctatgtaactgaactaaaaagtggatctactctataatttattgtattataatacatatgtatacatctcacacactgtgtatttatactttaagagagaaagacttttataagactttttacgtcaagtgagggcatctgttcatttctgtagagcacatactgctttgctgcagagtgcagagagaatgactttgctcttcataccctaaaattgagtccaccagggatgaaacataggcgtgtagtagcaaaggcttctgtccagctgagcagtaaatcctggctgcccctgatgatcacagggactggctcctggtaataattttgatgtcattatcctctcctagaaatgcatgaatggttctggcctttaaaaacagatttaagaggatgcatttatcttgaccttatcagccttttaaagatcatgccgtagggcctgttgacctttctctcttaacgatgagttgcaaaacagtgggataacatcaatggatgaaagggagaaagagtgtgtaaccagaagcagcacccatggagaggaggaggtgggacagggatgttcaggctgacaaaggaaacttgctttagtcctgtgggaattgaagaatcccacataaatggaagcacaggaggcacaaatgggattccatttccatctctgctctaaatatgcagtccttgggtactgtgatggttaattttaggtttcaacttcactggaataagcaatacctagaaacttggtaaagcattatttttaggtgtctgtgaggggtttttccaaggagattagcatgtgggtctgagtaaaataggtggggaagatctgcctttgatatgaggaggcaccattcattcttccaagtccagaaaaggcaaatgtgtcaatctatctgctgaaactgggatacactcttcctctcttgttcttggacaaaaacttcaggctcccagcctttgggctccagaatttatagcagcaacccctttccccacctgaggctctcaggtctttggtcatggaatggggattgtcataagcttccttagatctaaggccttcagtcttggactgagccacactactggcatcccagggtatccagcttgaggatatcatgggacttctcagccttgataattacatgagccaatgcttttaataaatctcttctcatttatccatacatattttattgattctgcctctctggagaaccctaatagaggtatacatcaaggcataagtcaagaaaaataagatatttggcttattaagtggttggcaatgacttcaactcttttttttttttttgagatggagtctcactctcgtgcaggctggagtgcagtggcatgatctcagctcactgctacctccgcctcctgggttcaagcaattctcatgcctcagcctcccaagtagctgagactacaggcatgcaccaccatgcctggcgaatttttgtatttttagtagagatggggttttgcattgttagccaggctggtcttaaactcctgacctcaagtgatccacccacctcggcctcccaaagtgctgggattacaggtgtgagccactgtgcctggctgtgactccaactctccaacgggtaaagcacaaacacatttacttaactgcacccaatcttgtgaattttgacacttttaaattataggtagtgttcaccaattcaccactgtataataggaataacatgggattctgtgactgttcatgtaaaggattcatataaagctctatcattttctagtagagtttcccaaaatattttttaaaaatatcaagggtttctaacatctcaaggattaaagacaataataagtaaagagttcttcacacagttctttggtgatgccatgtgtttaattaatgctaatatcttctcccattccgccaaatttccctttgcaataagttgctcaatcgataaatcaaatgatgaaaaaaagatacagttgataaaaattagaaattgagaatgtctggcttccctgaaagttttgagatctagttaccgtgaccacatatttagggcaatacagaattttaacagagggaccaaaatttgaaattgaaagcactctgaaaaaatacaagagctgccatgagcacagtaaagatctctaatacacacaaataaaaatcgagtaagttaaaagcaccggcttttctgccctctcaacccaaggaggtcatatcaatgcacaaactaaaatgcacaattctatgcttacccactatcactacagcccagtgaatgctttaaatcccagacatggttaaaaatatagctggttatgtgattttctattaaacctaatatagtgggatgaaccataataccttacaggagcagatgaactagtatttccaaggcaaccaaaggatatcaatatcactttattattattattattattttcattctgcaaggaatcttccttgaagagcaattccttttatgcattggtctgcttgatagctttctgaataactgtaatccataaggctttgtacctctttttgcatgctggaaacactctgacttaatctaattatctcatgaaacttcactcttaaataaagcttgaagtaaaattagaaagcagcctctttcttttcctttagttactgtcttcatggtaccttcctcttggccggttgctcataagaaaatgggctatgcctctgcagagaaagcattctttacacttctctctggcaaggagaagttgggtttgggccaagtcgggccccatgaaaagagaataaaatatgactggaaaccttccttctgcatgacaaaggagtggctggctagaagcaaacatttattgagcaaatattggaagtcaggcacgttgaaaatatcactggtctaagagatctcagatttgccagggagaaaaatgggccaacatgggatgtcaatatactccaataaagcctataagggtcagcattgattcattatccaaacagtgtgacatttgagaatgaaaggggagcatcaaaaattctgcaaggacaactgacataaacattatcctaattaggatctaaatgtcttgaaacacaaaggagaaccctaattgaagtatacgtcaaggcatgagtcaagagaactaagatttttggcttactaagtggttggcaatgactccaactacaacatggatttggaggaaggtgggccaccagaggtttcagagaaatttttgcgttgggtcatgaaggaaaaatagatgttgttaagtggagaatcagaagaatgtttcatacaaaatgaaagagcaaggacaaagatatagagtagtaaaattggatactgtggctcataccaatttgaacccagagaaaacaattagaagatttcatttttccccttcatattgaaaaaatacaaaagactgacaatgccaagtactcataaaggcataggttaatactccatgtataggtagaactaatttggagaatatcaccgaagtgtctaataaaattgaagatgcatatgccctataatccggaagtcaaattcctgatataaacccacatgtgtatccaagaataaaaaagaacattcattgcatattgtttatcatagcgaaaaattagaaataagttttcatgaagtgcagaatggaaaaataaattgtagtaaatccatttaatagggtactattcagcagttaaatgaactaaaacccaatggatctatcaaaataaataagtctcaacaaacatattaagtggaaaaagaaaacaagctacagaaagatatgttctataagataccataacaataaagattaacagcatggaaatagtactacaaactgtttaatgtatacattaaaaggcttgcatggctactgtacataatgctgcaatgaacatgcaagtgaaaatatctcttttgatcaattatatacaatagggtttgcactcctaagagattattcagcttttaaaaagaagaaaatcctgccatttgccacaacatgaatgatcctagaagacattatgctaagtgaaacaagccagatacaaaaatacaaatattgcgtgatatcacttatatgtgaaatctaaactagtcaaactcatagaagcagagtgaaatggtggttgacaaaaattcaggaaggggtaagtgaggaggtattagtcaagggtacaaagcactttatccgcacttggaatatacaagtcctagaaatctacagtacaggatagtgcctatagttaacagtattgtattgtatacttaaatatttgctaagatggtagatcttatgtaaaattttcttatcacacacaaaatagtagaaataataaagagagcagaaagaaacttctggaggtgataggtttatggcatagattgtggtgatggtttcatgagtgtgtatttatctctaaactcatgaagttgtatatattaaatatgtacagcctatgtcaattatatctcaaagttttttaaagcttgtgtgagaatgcaaatatagagtcttggacagtggtttgatctaggtagaaaagtaaagaagagaatcaattaagatgtacatagttgcctttaactgtgattgtatctttatttcttaaaagagaagagggaaatgtgacacaaattggcaggtttttagatctgatagagctgggggatggttacataggagtcccctctattttatggggagattagtagggatctgaagccaagctgtctgagtccaatccagtccagctcaaccacttcaccagtgcgtgacaccttgggagaatgattttacctctccaagtgtcaactcctttcctataagatatggctaataacagtgctacaatgactaaatgagttagtgtttgaaagctcttagagactacaggaataaataagtgatggtgaaataaaaataaacaatgtattgcacagctcaagtaggtagaggacaggagagctgggatgggtgatgataaccttacttcaatctcatttttcatgacaaggaaactaaggttaggggagtagaattaactttgattacaaggtagaagcaatcagagatatcacactgggctcacaacaaaagaactgtataactggaaggctccttggtgatcctactgatagggacaggaggcagagaaattctagccagaaaagggtgagtctctggtgaagccccaccttcaagctgaaaagcctgaaacaacagcccaaagtgagaaattctatcgctgtttttccacttgaatgtttccttttcataaaccacccatggccccaccatgcctcatcctgtgcctataaagaccccagagtcagccagcagagaggaggagcagctggatgtcagagagcagcagcttgacttcagagggatggcttgatggagtaacttcagagaataatctggccagagatggctagacttcaagggaagattacctaccctctcatccgtccccttttcagctccccttcccagtgagacccactttcattggcaataaaatctcctgcatttaccattcttcaatttgtgtgacctcacttttcctggatgctgtacaagagcccaagagccatgagtgtagatacaaaaagctgtcacactggccctttgcccttgctggcagagggcagctgcctcacacaaaaaaacaaaagactcactgagctgttaacatttaagccatccacagatggcagtgctaaaagagcactgtaacacatcatctggggcttcaggggtcacaggcacccctacctggatgctgccgtggggcccacatggagttcactcctgctggtgccgatgtgtctagtcagttccaacactcatgcactccagttcctgcctcgttcgctcatgcactctctcccatgaggagttgagggcggtgggctatgtaaatgaggcattcctgttgtgagtcccatgaaggggtcagggaagtatcctgcttcactagcatttagtacagaagttgacaaaacttttccatagaaaaacaggccttgggtaggatttggctcatggactctcaggctgtagttggccaacaccttgtctaggggttctcaaatattctatgcatcagaatcacctggagagctagttaaacacagattggtgggccccacccccagattttctgattcggtaggggtggggcctgagaatttgcatttcccacgagttcccagaggatgttgatgctgctgggccaggggccacatgtgggggtgtccaccgttataatgtaactttctcattttatacttgaatagaatgaggccaaactggatcaatgaatagaattgatccaattttgttaagtgagatcagacagcaagtaaaagaatttaggcttcattcgaaatcttgtttattttaaaataacatataaagttacaactgtatcctgggtgctgtgctaggctctgggtatataaagataaatgtgacatggtccttgccttccagaagcttgcagtatagtagaagaaatgagataatagatgatacagtatgtaagactcctgggagcataggaaacattgggaccccagagaattacctggtttcttgaaggaggggccacctggagtatcttgaagaataaatagtcatccaacaggaaaaataggcaggtgaggggaggaaattccaggtaaagggaacagattgtgtaaggcataagagaagcaacatggcatcatgcttcacagtaggaattctggctctgctacttactagcctgggtcagttatttaacctgaaaacctcagtgtcttcttccaaacatagggataataaaagaactgaccacctagggttgatgtgtgaattacataagataatgaatgtatagtgttttggcctagtgcctgaaacacaattagtccttaataaatatgggcaattgttatttgtgttattattatagccagtgatgtatcagagcatgatacattcacagtcattaatgaactaaagtatgaggtgcaggtggagctactgaggcgggcaaggccagaaaatgaaggactctagtccctgcctgactcagggagggcagtgagcagagagtggcagaagagtggcattctaaggtctccattataattgaaggaggagagaatgattaagacaagtgatgtggtaaccaagaattgggaaaagattttgaagaaaagatgatgaggtcaattttggaaatcagtgggatatcgaaatggaaatgtctggaactcaaaagaaagatcttggctacccaaattcgaaatccctgggttggcagttgaatagatggaagtgaaatatcaccctgcaatattatgtagggagaagagagttcacaccaatgcttaaaaagtcagcattgagaagtagaaaagaagtagaaaagaagaatcatgagacagcatccaagtagctaagagagaataattttaaggaggagttgcagtcaacaatatagaatactccagagatcaagcaagataaagatcagtgagtaacacctggatttagaaccaggagaggcaacttagacctctgctttatactaggtggaatgcattgtgtacatttcataaagaaatatatatttgcatataaggtaaaaggggataagcagaaattaagtcaaagagcaatttttctccccataatgaacaaaataccctcctcctaaaaacctcaagaataaagatttgaaagctttactctcaccctctccccaaggacattccaagccctctgtgatccccagatgacactagaccagcctcaactcctctgacatttttatgaagattgtcttaactatgcagagtctgtattttcccaatacacaccgtgacttttctagcctctgtgcctttggtcatcctgctccctcagtgaagaattcccttaacttttcctaaaataaggaaataattctctcataccttaaagcttgattcttgttccataccagaccctcattatcttgcccacctactactatcctctggcccaaaactctttatagcattttttttttcacaacctacactccttttatttacctcctcaattcctcaaggtgaaaaactactccctctctgttggtgtgtattctatccaattgtttcgttgtatccaagtgcctggtatacagaaggcagtcaataaacagtattgaaaggatggaggaaacaggtatcatgcttaaaatgcatttctaaataattcaggacaagcaaaagaaaattaattaagaagttatgcacataaactgaacaactgagtgggatacagagaactgaagtttacagagaggatgtgggagaggggacggcttacgaagaagaggaaagtaaccaggtatctactaggcacacttgtcaaaagtaattttatcgtcacataaactttaaaatactgttatcgttcccatttcaagaatgagtgcacagaagcttggagaggctaccaatttttgcccaaatagagcagcttatgtcagtacaaaattgaatatgattcttacaatacttcaggattctgataccatgttgctttttggaattagaatacagaagactaaactgaattaaacactaaagcaagatgtaaatagagacttggcatccattaactgatctagtaaatggcatctgtactgctgaggcaataacagatacgtgtataaaaaatggatttataaaggagagaaatcagatctgtctcatctacttgcctcatacaattgtgatgagaagcaagtaagacaatgtattttgcaggcattttgcaaaactggaacaactctctgtatctaagagacaataagttataggactcctgacttcctccctgctctacactctttaaacatttctcttgccaattttttgcttatcctttcctttttgccttaatcatcaaaacatgattgcaattaagacttggtgtttctctgggtcctgtttcgaattattttaataacatggtatatttcaagaagtatttcaaatagtgtcatagaaattttgactaggggtcagaaggcctgttatttctcttggcctcactttctttacctgtaaagtgagagaacggaattaaatgatttctaaaatttttcccaactcatgcattttataattatttactcttctgaaattcctgtgataagggaagtgtagattaattctcccccatcttgacaatttggttcttaggaatctgagaatatctttattttcttgttcttgatatgattccaagaaagcaaatacgtattagacaaatttctctctgagtattattattgtagcactgaaatccaggatgagtaactttttcctctaaatattagattaagttcctattctcactgttgacagggattaaaaaaatacttccattccacacagcaccttttgtcagctagaagctgatagaaaatttcaggggagaagtgatcatcttaaacagcaggccctggctttaattcagggaatgaaagttacattgattttttttaaagtgatctgaaaccagcaggaatctctatccaaagcccagacagatggctgaaccaatgggctccctgtgatcatctctgctacccatatatcatttgggtagaaaataaatgggttttaaattacctttagttccagatagacctagaaattaaatctctacacatttgaaaaaagctaataccaccttaagctgcattaatagaaatcaatttctttgtcatgggaagtaattgactcattcaccctatatttaagttagaatattcatttcttttaatcatatgctaagtgtaaaagtaacacattagagtttgtccaaagaataatgggtagtacattaagagggtctgaaagtcatgttctctataagacaacagaggattgtaattcagataaaagacgatttaagagagacctcataatggtcgtcaattattaatatataatacagtacattctatgttattcaggaggacatagcagataaacaggaggaagagatatttgattaaatggtacagagaagattccaaaggatcaagcaatcctgagttagaacaggtcttctcagaaggtgacactgactagacacacaatgtgtgaaggagtgggcaaatggctatcagttggagatgatatagctgggaagtaacaaatattctttataaaattaagatcccctttttcctttcttttttttcttttttttttttttggagtcattctcaagtcactttcaaaatcaataacagaaaaaccaccatctcccctggaggaaagacatgggctctcatcttcatctgtaaacatggaaccctgatatcaggttccataaatatctgctctatttatgagtgctcatgtttgttttccactagtggtatcatttttattacaggtattaggaccctcatatccttttctatgatagcaatttgctctctgtttttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaaaaaatgtcttgtttagagttcaccctatctgcaaaagtcttaactttggagtcagtcacttaacattcttggttttagtatatatttcaggaaaagatgtaataaatcactccaagatacaaatgcatctgggaagcagaatcattccactggaaagcaagacaaagggggcagtgctctgcaggtactaatcagatagaaagaagcagctgagagcgatttcttgcatctgtttatcaagtacataaatactttaagcacctactgttagccaggcaccgtgcaggcagtatagcgggtggaaagatacaaattacttgccctctaggacttgacagtctgtacacacaaattcctataatgtgatgtctatcgtaaagagtacaaagaaagtttaagaattcagaattgaatttgatcattttcagctgaaacatcaaggagccatgaaagggggtaatctaaagctggcttgtgtggaatgagtcagatttcaacaggcaggtataggagccctcagggtggggtagagtaggaaaataatctgaatatgctgagaggcatgacaaagctgctgagctgagaatgctgaggacatacccagggaagagttaattagtccaggttgacagcagtagctacatgctggggaattgtgactgatgagcttagaagttgaggccaaattgcagatggctttggctaccaggagagatgtgtagacattaccctacaagaaatgggaggtcattgaaggttttcgatcaagggtataataggatgctgttgtgctttgattagtcttgttgcaatgactaaaaaatgattgaagaaaataaaaacaaggtaggggtttatcacaatattctgaaagcctgaaaccacaatggtagcagaaggcataaaataaaatgacatatataagaattattttgtagttaaaagctatgagtttgagcaatattgactttaagtggtgggcgttaggaagaatcaagatccagaaggctaaacaggagcagaagtactttcattgccatctcacatattcacttatgattgcgagagtctcactgaatccaggtgtgaccacaggatgctcagaatagtaccatggcagagtactcagaatgtgaattctgcagctggactgcctgggtttgagtcctgattctgctacttactagctatgcggccttgagtaagttactaaaccagcacatgcctcctctcataaaatatggccaacaatcataataattcctttatgtgaaagttaggagaaataaacaagttaacatttgcaaagtgcttggagtcatgcctggcacaaagtaagtgttttacaagtgtttgttaaaacaaacaaaacctcactatgttcacatagtcctatattaatgtgagttgccattgtgggtgaaacttttggcatctctgcccatctcctaaagcgttgtcttttctttgttcttaatcttttgtttgaaagctatattttctctttagccaatttcattcactcagtggctataaatatcatttgtatgttggcaggagacaaatgtgtatgtcccctcagacttctcctgccaacaagatgccttcttttgaaagtttcacaagtgcatcaaaattagcatgactaaaacagaatacatttatgtgctgcatatagatgtttcagtcagtggtggactgtatatacaaccataatcctataagattatactggaataccatatgttttactggcccttttctatgtttagatatatttggatacacaaatactcgccattatgccacagttgcctacagtattcaggacagcgatatattgtgtaggtttgtagcttagcagcaataggctataccacatagcctaggtgtacagtaggcaatgtcacataggtttgtgtaagtgcactctatggtgtgttcacatgacaatgaaatagtctagcacatttctcagaacatatccccactgataagtgacacatgactatttgaatctccccaccccaaacctgaatcacctatagtttaccaattcagacaatggcaccatcattcatggaggtgttgtaaatccaaacttaagattcatccttcgttgcttttttttcccccattcaatacatcagtatgttctgtagacattgtctccaaaacatttccagagtcagtcaatttatcgctctctttactcctgactctccaagtctagtcactgttatttctcaaaagcacttctgtaatcgacatctaagcagtttctctaattccatgcttgcccttttctagttgattctccccacaacggctaaacagattggtaaacaatgtatatcatgcatgccactactctggttaacactctataatcactcactactgaataaagaattaaacctcaatattctcaaatggcctacaaggcctcttcttcccagcttctcattctcttttcatgtccttcaatcccttccttggctttctctatcatcttccaacatgccaagctctttctcacttcaaggacttccaaggtttgtgctccaccttgttgcaactttctaaacttgctggtccactgaacaaattctacttaaccttcagggctcccttcaaatgacatcttcccagcaaggccccccaactcttatttccttcatagaatgtgcatactttgaaaatacgtatttattgtagacttgtttggttgatatttgcctcatctcctaaattataagctgagaggacaagaccatatttgttttgttcactgctatacacccagaccctgtttagtgcctgggttgaaatgtatgttttgacaagaaagaaaagaaaaaaaagggaaggaaggaaggaaggaaggaacgaaggaaggaaggaagggaaggaaaggaaggagggagggaggggaaaaatgaagaatggaggaaatgaagagtgggaagggaggaaggaaggaagaagaaaagaaaagaaaagaaaggaagaaatgagggagggatgaagagagagaagaaaagaaacaaaggaacaaaggcacgtaaaccctggaagacaacctaggcaataccattcaggacagacatgggcaaagatttcatgatgaagacaggaaaagcaattgtagcaaaaaccaaaattgacaaatgggatctaattaaactaaagaacttctgcacagcaaaagaaactatcaacagagaaaccagacaacctacagaatgggagaaaaattttgcaaactacacatcctacaaaggtctaatatccagcatttatagataacttaaattcacaagaaaaaaaaaaaactccatgaagaagcgggcaaaggacatgaacattttcgacagaagacatatatgcagccaacaagtctacaaaaaatagctcaacatcattgatcactaaagaaatgcaaatcaaaaccacaatgataccatctcacaccaatcagaatggctgttattaaaaagtcaaaatataacatatgctgacaaggttgtggagtgcctatacatggttgatgggagtgtaaattagttctaccattgtggaagacagtgtggcaattccacaaagatctaaagagagaaataccattcaactcagcagccccattactgagtatatacccaaaaggacataaatcattctattataaagacacatgcatacatatgttcactgtagaactagtcacaatagcaaagacacggaatcaacctaaatgcccatcaatgatagactggatgaagaaaatgtggtacatatacaccatggaatactaggcggccataaaaaagaacaagatcacgtcctttgcaaggacataaatggagctagtagccattatccttagcaaactaacacaggatcagaaaatcacatacttcatattctcacttataagtgggagctaaatgatgaaaacacagggacacatagagggtaacaatacatactggggcctttcagagggtggagggtgggggaagggaggagggatcaggaaaaataagtaatgggtactaggcttaatacccgggtgattaaataatctgaacaacaaccccccatgacataagtttacctaggtaacaaacaaacctgcacttgtacccctgaacttaaaaggcttttttttttaaaaaaaaaaaaaaaaagacaggcattcaccaaccctgatgagtagccattgacttttgcctctcagacctggcaaggcattgaaacaatggagttaagaaggataaaccagtttggtatgaaaagaggactcacttagttttggcttattatcattcagggcacacatatttactgtctcctccatgcatgcttcccacatgttattacagaaaagatattagaaaagaaatgaatacataacaacttcaataaatatgaacaagtggtacttgtaagaccaggaattttgaggagttttcagaagatatcaagtgaataggatcagatttaataaaataataaataaataactaggactgagaataagctccttgtagtataatagcttttcttcctaaattctcactggctccttagataaaggttaaacctgctgacaaaagtactcggagcagaagcagcttacatagggcaataactagagtacaacctatgaaagccttggctgcttttccttctcctcctttgcatattaatgctaagtttggatatggcatttgctcccatattgaaaccgtgtaaagggccttccagtaaagcaatacagtgtgtatgagtatgtgtgtgtgtgagagagagagtgtgtgtgagtgtgagtgatgtgtgtgtgtgtggtggcttcctactatgtgcctggggccagagagaagcagaccaaaccaaggtaacttcagaaccacacagctgacacagaaatgaaaaaataaggacaattctttagaggactaaaatgcaaccatacatatcacttcctaatgttttccttactttagaaatagatttcaccaacttgtctctttatcctctgctcctatatcttgaaggaagatggtgaaatcagcattgtctccatttctaaccctctcattaaaagtagggggctatcataggcacaggtgtaactgcagaggaaatcataccagcttccaataccaactgagctctttgtttaaaacaggaacaaatagataaacataaccagacatctgagggaaatcaatagcatgagagagaagaaccaagattaacaaagaaaggtaacataaaaaacaaaagaaaacttttaaaaagttcaatcagtatacttgcaagaatttagcaaactaatatgtctataaaataagaaaatactcaaacggataaatagaaaaaatgaaaagtttttggaaattaagatataattgtcaaaatttaagaaggtaacagaagtcctgtacaaaagaatggacattgctgaaagccaaagaagaaatatggaagataagaaaggaaatctaaaaattaacataaaaaggcagagatagaaattgagtgcacagaaaggatacatgttgcgggaagtcagggaccccgaatggagggaccagctgaagccatggcagaagaacataaattgtgaagatttcatggacatttattagttccccaaattaatacttttataatttctcatgcccatctttactgcaatctctgaacataaattgtgaagatttcatggacacttatcacttccccaatcaatacccttgtgatttcctatgcctgtctttaatctcttaatcccgtcagcttcataaactgaggaggatgtatgtcacctcaggaccctgtgatgattgcattaactgcacaaattgtttgtagagcatgtgtgtttgaacaatatgaaatctgggcacctcgaaaaaagaacaggataacagcaatgttcagggaacaagggagataaccttaaactctggctgcctgtgagccaggcggaacagagtcatatttctcttctttcaaaagcaaataggagaaatatcgctgaattctttttctcagcaaggaacatccctgagaaagagaatgtgtccctaaggggaggcctctgaaatggccactttggggacagctgtcttttacggtcgtacataagggatgaaataagccccagtctcctgtagcactcccaggcttattaggatgaggaaattcccgcctaataaattttggtaagactggttgtctgctttcaaactctgtctcctgataagatgttatcaatgacaatgcgtgcccgaaacttcattagcaattttaatttcgccctggtcctgtggtcctgtgatctcaccctgcctccatttaccttgtgatattttgttaccttgtaaaacatgtgatctctgtgacccataccctaattgtacactccctccccttttgaaaatcactaacaaaaacttgctggttttgcggcttggggggcatcacggaacctgccgacatgtgatgtctcccccagacacccagctttaaaatttctctcttttgtactctttcccttatttctcagactggccaacacttagggaaaatagaaaagaacttacgtgaaatatcgggggtgaatttcccccgatagatatggaaattataaatggaaagaaaaaaaggcattaaagacccatgtgttgcaaaaactatccagaatgagagagtaggggtaacagatgggagaagataatcaaagaaataatagaagaaaatttttctaggaagtgacttgaatattcatttagtcgataagatttactgagctcttactttttgccaggcattgttcttagcatttacagatcaggaaacaaaacaggaaaagaaatctctgcctcccacaaataattaacaaacatatacacttagatatatcccagtgacatttttgaacttcaggaataaagatgatatcctaaaaaagccagtaaggcctggtctggtagggaacatttatctacaaaagcattagacttatctgagactctttgcaagctggcaatagagtaacacctaggactatcttaaggaaagaaggtaattttgacactagaattttattaccagatgaactgtcagtaaagtgtgagggtgaagacaaaccttttattggacacctgaggactcagaaaactcatcactcatatatccttctggtgaaaaaaaaaaaaaaaacaaagcaaaacttaaatatggagtttccaaaactataaagtgaatttaaatatataccacaatatgtgagaaagaatagaaataatctaggcagtaaaacaaatttagtgtgatatctgaaaacaaggttagaaagccatcagttgatattagaacagcatgttggaggctccaagaatgtattcaagaaaaagtagttgtcataacaccaaattcctgattaaaaatcaagactgtaaatgtattgtgaaactgatatattattgtgtgatatattataaaaagtcctataataatatattactgataccgtttcagacagatgagatgaagggttattttctcccaattagccataaaaaggtaatattttcctagtaaaaataaatgcaagaatggcagtgtctgaatataaaactcttttaaatgaggcataattctgggcaactgatatagtgttagaaagatccttcaggggaaacccatcatatctctaagaataaggcagatagcctcaaataaagcataaaagtatttataattgatattagctacaccctgtgaatttcaggtgatcacatggggaggtaaagctgaccaaattcttggaatatgaggttgtaactgggaagtgactggaactagggtgggagattttgtagtagttcacataaagcaggtgaccactgatggaagctgtgagaagaggagatggcagatgaagaggctctggaagtctaccttttaggaggtgacatgaggaagagcaggcacagcgggctgcaaaggaaccctcaaatctataaatatgcactcttccagaaaggaagaggaggtgtccaaaatgagactcactggtgattggtgattggaaaggcgacaagggcatttggcaggaagtgatgacccaattctgttcagtgagggaagaaggcagcttgcagggcaatttggaattggaatgcaaaaatcataagtcaccatggcgtctattcataagaagtcatgaagcgggttggtggggagaaagaagccccctaacctcagccatgatcatcaaaacgggtccttcaactgaggctgggctgggaaagaggagctggcttgctagtgttgtgaaattttcaaagtaagagcatcccatgctggatacttgctgcataaaagcctttgctatatagtttatcttttttaagactgttatagaaactacattttataagtgtccacaggcatatccctgtcatgcttttgcagttataagaagtagaattcctggttgggagttatagtcttcctgtctttgattttcttctgcttgacaaaaaggaataacctgaggttaaagcatcctgctgtgtattctgtaaacaatcccattatcatacaaccacccagtgagcactacttacccttacaaagtatcaacagataactaaactgctcttcagtaaagctatatctgatttcaagtacaaataaaagctctaaatagtcacacagaatgatatagttgatgtaattcaagctctgttctttgtgtttacaatcatagtgctattgtttattttatatgaactgctgaaattcaggaatatgtggtacaacagcgattagagacacgacttggcctacagtagctccaccaatctggaaccctttgaaatgttctcttggaacaaaactcatgtagctgaatgcctctgtgttggaggctaactgaataattagagtttcccccatcaaattctatgtaaaatacagtgcatagtagagaatcagtaacaaaaacatgcaattgacccttgaacaacatggggtgtgagctacgtaggtcgacttatacacagattattttcaataagttacactgagggtgcctgcccatcctgcttccccatctatctacctcttctgcctctgccaccactgaaacagcataaccaacccttcctcttttccctcctcctcagcctactcaacatgaagacaaggatgaagatctttattatgatccacttccacataatgaacagtaaatctattttcttttccttatgactttcttaataacattttattttctctagctttgtttattgtaagaatacagtatttaataaatatataaaatacgtgttgatgaactatttgttatcagtaaggcttccggtcaaccataggctcttagtagttgagttttgggggagtcaaagttatacatggatttttggcggcatgggggtcagcatccctaatcaccacattgctcaagggtaaattgtattgttaaaactcaacagtaactacagcaattgtttagagcttagacccacaaaaggtttttcgaagtggagtattttatcactggcatttttacaatttccagcacctggggataataaaaagcaggtcatttggtgggtttcattattattattaaattctctccagacaatgcacgctgttactgcctgcacccagcatggaacactccctatgttccttcctttgtgcacttctgactgtgtagatcctgaagttccaaagtgtttctcaagaggttgattagctagaaccacttgtgttgattggccagaaatttcctggtgtgactaggaaagccatgaacctctgagaaggattggtacaaaagcctatccaacaggagtacttcatattggatggctgcaacgtgacccaaaccctctcagtgctgaaatatatatgcaggtttatatacacttacatgaggtagtgtctttaagtacaatacgctgtagttggcacatactgaaaagccttacacgtgcctccctggatcagatggaactcagaaggatcaggaactcagtaatggtacaattgatcaggttgcttttatacaactttaaatagcctaaagcaaaattataataataaaaatcgtaatatctttgtatactttcatagtctatgatgcaggactaactctaatacaaaattttatttttacaaaaatgtttgagacacatttctcattgtcttattgtctgtattttacaaatgagtaaactgaggctctgagacattaggtgattttcaaacattattgtccatcaaatggttggaacacaatggagtgggatccaaagcatgaccttctaagtccagtgggctttctgccgtgcagctctgaagtgtggtaataatagggactctcataaatgaaatgataaataggactgcttactggttacatgaagttttcaatctgttattaagtagcagttcagatttcactatgtttaatccaccagcaatgatcttttccatcttgcatacctggcagatgcctattcatcttttaagccctatgtcaagagaagccttcatctgcaaagccttttctgaccccaaaggtagggttagttgttttcttttttctgcagccaatccacatgtgtggatcccaccactcatgtctcacatgccttattaggctaaactgtaactcttaatttgcatgtctgtctctaaactcaactgcgagctcttaagatcaggagctgtcatttattctgatttgtatacctagtgtctagcagagtgtctggcacatcaggctctgagtaaattttacacactatgcatccccatttttggggaaaagaaataacaaagtatttctaattgagggtgagtcagtgtaacatcaccctctcatactgagagaatatatccattaaattctgcttgcttcctcttagagatgaaaaatcagaaatctagagagagagacttgcatcactgcctccacttacaaacactgatattgagaacataataaaattatcctgtggatgaaatcaatattctattccttaatgctgctaactataacttccaaaccaatcttagcaagctcacaaaaaaatatcagagctggaatggttctttggaaaccatgcagctcaataccctgattctataggtgaggaaaacaagctcctgatatgctaagtgacttgcctaagatctcatgtttggtcagtggaagacacaagccactgagcattttccagaacccgttgctgcatctattatccaaaggaggaagacaattgataacaaaaagtccgggggcacaaaatactggtgtgctcacccacacacacactccctgcccaagaaaattcaatggctgaattagaagatctatcaaatgtaaatgacaagttaacaggtgcagcccaccaacatggcacatgtatacatatgtatcaaaactgcacattgtgcacatgtaccctagaacttaaagtataataaaaaaaaaagtgctaaagaaaaaaaaaaaagaaaactcaatggctgaaatatgaccttacacagttaatgactgactacctccaatggagagagttattcaatatgccacagggctcattaaaatgcaagttttattcttaagataacttgaaacaaaattctactctcaaacacaaaggtttacatacaattttgtagcaaaacaattgatgtcataaagtaagacatcaggaggggctttggagtacagtccaattcgagaaatactacctgttaatgcaagtgatctggttctaggtccaactccatcattcatttgttctacaactaaagatcaatctctagccttgttgaatcttccacatttactgattggtgatagaaatacgtgtctttttataagttgtcacaaatgagacaaacacatgttgatatcacgtaccctctgataggatgtaatgcaaatggaactctatctccagggaacctttccccaaaactcacaatcccagattaaccaagaaaagcatcaaacacacagaaattcaggaattttatacaaagtagctcaccagtatttctcaaaactgtcagtcatgaaaaatcaaaagattcagaaactttcacagcccagaggagacgaaagagacatgaaggctaaatgtaatatggtatcctaaattggattatgcaacagaaacaggaccttagtggaaaaactcggatattaaaaaaaaatctggagtttagtttaccagtaatgtatccaggttggtttcttagttttgacaaatgtattgctaatgtaaggcattaaattagggaccttggataaagagtatatggaaactccctgtataacttttctgtaaatctaaagtcatcccaaaataaaaaaattattttgaaagatgacacctggaaaggctttctaaaatgtaataaatgatatccaaatgctagatcatgtctagagagaagatagatttgtgttgagttttcagtggattaatctggcatatagccttttatttttgcctgtagttcatttttttctagaagataagcagaacagtactattgtctatccaagaagtatcacctgttaatcaaatttatacatatttgtagtggaaagagcattggattagaaatgtgcttatttataaacctgcttctacgttgacctgcattggaaatttagatagtaactttatctaatttgctttgttttctcatctggaaaaaggggagtatgagtgcaaattttgtaagggatgaatgaagtaacatgagtaaaccagtactgacaactataaaatcatatgttcatgtgatgggttaattgtgcttccattagctttggagataatgtaagtatgaaaaaaagaataatggtcttcccaaaatgtccatattctaatccaccaaacctgtgaatgtgttaccttatatggcaaaatatattttgcagatatgattatgtcaaggatcttacgatggggagatcatcctagattatccagatgggccaaatgcaatcacaaacattctgaaaagtgggaggcagaagggtcagagttagagaaagatatgtgataacagaagcacaggctggagccatgcaaggaagggaccctgcactgagtaatgcaggtggcttctagaaggtggagaaggcaagggattgatttctcctcagagcctccataatgcaggctgccctagtgacaccttgattttagtgtgtccaacttttaaaatggtaagataataaatctgttgtttctagctactaactttagggtaatttgttataagactgatatggttagcctttgtatccccacccaaatctcatcttaaattgtaattaccaggtgttgagagacctagtgggaggtgattggatcatgggggcagtttccccacatgttgttctcatgatagtgagttctcatgaaatctcatggttttgtaagtgttcactggttcctctcttgctggcttcttctctctccttcctccatgtgaagaaggtgtttgcttcccattcaccttccgccatgattgtgagtttcttgaggcctccccaggcatgtggaactgtgagtcaattaaacctcctctgtttataaattacccagtcttgggtagtatccttatagcagtgtgaaaaaggactagcacatggagctataggaaactaatacaattactttaactatcacttaattgggatgtattgaaggataaacttactggcttatcaaagggagactgaatgtgggtctcttggaaggggtggtcacatactgaatttctgagggagaaaacctcataaattcactatatgccgcaaagcaaagctttcaagaagtggtgtggccacttttttttttttttttttttgagatggagtcatgctttgttgctcaggctggagtgcagtggcacaatcttggctcacagcaaccttcgcctcccaggttcaagtgattcttatgccccagcctcccaagtagctgggattacaggcacccaccaccatccctggctaaggtgtggctacttttaacagcttacagtaagatatggcagcaaaggaattacctaaaggtggaatttgtaattaaaaggaaagcagaatataaaaacatgaaaaatttacagtctagcaatgtgacaggaaaggaaagaatgttttcaggagaaaaatccagtggtgctgaggggtaaccacttgttaaagagattaaaatggataaaagggagtcaggtgcaaagagtcaaaaaaattggaaaaaggtttttcagaaatctttgtagccccctcccatcataggcccacaggcctgggaaaacaaaatggtttcagggaacaggcccgagttaccccgaagccactttgatatgctttctcaacattcaagctgctccagctccaggtgaggcacaaataaccccacatactatttcagctggtgctccagagggtgcaagccataaatctcagcagcatccacttggtgctaagtctgtaggctcctagaatgcaagagcagtggaagctgccaagcctgtagatttcagaggatgtattggaaagcctgggtgcccaggcagaagccttctgcagggaaggagctcctacagggagcctctactagggcagtgcccaggggagctgtgggaacaggagcaccacacttcagacaccagaattatatagccactggcaatgagccacactagcatggaaatgctgcaggtattagattccaaactgtaaaagcagcaatgtgggctgcacccagaaaaactgtgggggcagggctttccaaggacttgggagcccacttctcatatcagtatgcccaggatgcaggacatgggtcaaagaagattattttggagctttaagatttaatgtctgccctgctgggttttagacttccatgaagactgcttacccctttcttttggccaatttttgtctttgtgaacgagaatgtttacctaatgcctatacaaacattgcatattataagtagatgaattgcttttgatttcacaggctcataggtggaaggaacttgccttgagtctcagatgagattttggatttgggacttttgagtagatgctagaacaagttaagactttcgggaccattgggatagaatgattgtattttgcaatgtgagaaggatgtgaggcatggagagtcaagcgtggaatgctacagtttgaatatctgacccttcaaacctcatgttgaaatttgattcgcaatgttgcaggtggggtctaatgagaggtgtttgggtcatagaggcagatcccttatgaatggcttggtaccacctttatagtaatgagcaagttattgctctattggttcctgtaagagcttgttaaaaagaacctggcaatttctctgtatctcttgcttcctctctcaccatgtgatctttgtacatgctgcctccccttccacttgcactatgagtagaaacagcctgaggccctcaccagatgcagatgctggtgccatgcttcttgtacaccagcctgtagaatcatgagccaaatgaatctctttatctcaaaattctttatgaattatccagcctcaggtattcatttacggaaacacaaatggaataagacagcccccaacattcctacctcatagtgtacacaccctctagtatgagtgagatttctgagtataatggaatttcacttccttgagtagactgccatttctggcaaagatgaacagattttgcagatgtgaataacgttcttaatccgttgactttcagttaataaaaaggcatgttatactgaataggcttgacctttaaaagagagtctaggccttctcaggatagggagatttaaagtaagtaaggcactttcctgccaaccttgaagatgcaaactgtgttgtgaactgcttattcagcagtggcaggccataggagacaagggtctcagccctacaactgcatggaattgaattctgccaaggacccacatgagcttgacttcagatgagaatgcagccagaatgacacctttttcagccttatgggactcagtagaggatccatttaagccatgtccagacttctgacccaaggaaactgtgaaataacaaatgtgtgtcattttaaactactaaataaatggtaattcttaagtagcaaccaaaaaatcaaggcaggtaccacttactccatgaattaaggaatgaagagcatgcacagccccaggctggccatcctggatcagcaagtaaccctcaccaaccagccagatttctttcctgggagtactgtgaagaaagaagagcttacactccttacctgttaatcatgagactttttttttttttaaagtggacattttgataaacaattagacatcagtggtaacttgtaggtggttgggtataattaccttccttgtccaataatctttagattttaaaactacccaaaaagaaaaggatggaaaatagcaagctgggagggttattgacctgggtaaaccatttgtacccaattttaaagaatgcaacagatgatgctgtcctgagccaaagtagcctgctaggtccaatgctgatcagaaatggcagcaatgagttcctctattaatcattcagaggaattctgtattatgattttaagctgctgaataagtggtgatctaattcctcagaaattcctgcttcccagatctcagaggaagagtaaagtgcttaaaactatctattgtcctttatttccaggatctccatccaaatactttatgtggcccacaaggccctctatgagctggcccctgaccaccccaatctccaaccattttgcacttgtcactttgcactctggccacagtgacctttgttccatttctcatacatgtcatgcccacgcttgaggctcatgcttctgccttaaacagctggtctaagatgactctgcactagcaacgtccttccttagcttagcttctcctagattacacaaggaggctctccttgatctccagactatttctactaggctttttaaaaccttgagtactttccatttatagcatgtactacagattgtactgatgtgtttgttactattattattttataactcaatttaagggttgaggaacagcctttcactctgtctcccgagtcaagcctttgtctttttctttaaggaatattgctgtctattctgacccaagtttgtttggcaaacattgagcccctggtgcatggaaggcctgaggtatatcctcgaggaataggtggtgggaagagataaggtccctaactctagaagctgaaccatccctaggcccctcactgctcctatcttagctcatatggccctcttctctgactttgaattctgtaagagtttcaatctctcctttgattctttagggtaaaatccaaacttctagttcctttcaggtaaaatccaaactcccagttggtatggccctccataatcaggcccctgctgctctccaaggccttaattcccagagctcttcttgcactagtgaacattctcttccaagcttccaggcttttgcccattgatatggtttggctgtgcccccagccaaatctcatcttgaattgtagttcacataatccccatatgttgtaggagggacctggtgggacataattgaatcatgtggacagttactcccatgcagttctcttgacagtgagtgagttttcatcgcatccagttgttccttcactcagctcttctccttcctgctgccctgtgaaggtgacttgcttcctcttccaacacgattgtaagtttcatgaggcctccccagccatgctgaactatgagtcaattaaacttgatatctttataaattaaccagtctcaggcagttctttatagcagtatgaaaacggactaatagagtaaattggtatcacagagaatggggtgctgctctaaagatacccaaaatgtgaaagtgactttggaactgggtaacaggcagaggttggaatggtttggagggcttagaagaagacagaaagatgtgggaacttcctagagacttgttgaatggctttgatcaaaatactgatagtgatatggacaatgaaatacagcaggctaaggtggtctcagatggtgatacggtttggctgggtccccacccaaatctcaccttgaattgtaataatctccacatgtcaacggcagggccaggtggagataattgaatcatgggtgcagtttccaccatactgttcttgtagtgaatgagtctcatgagatctgatggttttatagacgggagttcctctgcacaagctcttttgcctgctgccatgtaagacatgactttgcttctccttcaccttcagccatgattatgagaccttctcagtcatgtggaactgtgagtcaattaaacctctttcctttataaattacccagtcttgggtatgtccttattagcagcatgagaacagattaacacagatgaagataaaaaaacttgttggaaacgggtataaaggtgactcttgctatgctttagcaaggagactggtggcattttgctccaccccagagatctgtggagctttgaacttaagagaaatgatgtagggtatctggcagaagaaatttctaagcagaaaaccattcaagatgtgacttgggtgctcttaaaagtattcaattttatacattcataaagagatggtttgatattggaacttatgtttaaaagggaagcagagcataaaagtttggaaagtttgcagcctgatgatgtgatagaaaagaaaaacccattttctgaggagaaattcaagctggctgcagagatttgcataaggagccaaattttaatagccaagacaatggggaaaatgtctccagggcatgtcaaaggtctttacagcagccctcccatcacatgcccagaggcctggaagagaaagtagtttcctgggctgggcccaaggcctagctgctttgtgcagtctctgggcttggtgccctgcattccagctgtggccaaaaagggccaacatatagctcatgctgttgcttcaaagggtgcaagccccaggccttggtggcttacatgtggtgttgggcctgtgggtgcacagaagccaagaactgaagtttaggaacctctgcccagattttggatgacgtagggaaacacctgaatgtccaggcagaagtttgctgcagtggggagccctcatggagaaactctgctagggcagtgtggaagggaaatgcggggtgcgaactcctacagagtccccactggggcactgcctagtggagctgtgagaaaaggaccaagatcctcctgaccccagaatggtagatccaccaatagcttgcaacatgcacctggcaaagctgtggacactcaatgccagcctgtgaaagcagctgggaggtggactgtaccttgcaaagccacaggggcagagctacccacctcttgcatcagcatgacctggatgtgatacacagagtcaaaggagatcattatggacctttaagatttcactgccttgctggattttggacttgcatggggcttgtagcccatttgttttggccagtttctcccatttggaatggctctatttacccaatgcctgtacctgcattgtatccaggaagtaactaagttgcttttgattttacaggctcataggcagaaggggctggccttgtcttagatgagactttggactgtggacttttgagttaatgctgaaatgagttaagactttgcaggacagttgggtaggcaggattggttttgaaatgtcagagacatgaggattgggagggacccaaagtggtacggtaggtttaggctttgtgtccccacctaaatctcattttgaattataatccccataatatccacatttcaaaggagagaccaggtgaagtaattggatcttggggtggtttctcccatgctgttctcatgatagtaagttcttacaaggtctgatggttttgtaaggggctcttcccccttcactcagcacttttccttcctgcagccttgtaaagaaggtatcttgctttccctttgccttctgccataattgtaagtttcctgaggcctcccggccatacttaactgtgagtcaattaaacctctttcctttataagttacccggtctcaggcagttctttaaagcagtatgaaaatggactaatacaatccctctttgcctgtgctgtcaagtattcctcacattaccacccttctccactttgagtactcctgaaccttgtcaagacccagttctaacttcctttcttcctttagccttgtagtgagatgcctggccctggaagactgctttaggctgcaagtgacagaaagtctgactcaaagtggctcaagcagtaagaagtttgttacgtcacttaacacaataagtggtgaggcagttccatggtgaattcaacccttaagtgagccatagaagatatgggtttttctcaactctccattttgccatcttagtgtgtcttttgtacccaagtttattcagaaggcttctccttacatggcatgaatagaactgtttatcacatatgcatgactatattaatgtattactctgggttctcctgagaaagagaatcaacagaatggggtgacagtgagagatttatttaagaaattggctcacatgatggctggcaaggatgatgtctacagcgtaagccgataggcaggaggcctagggaaatgttgatattgctgctcctggcctaaggcttctggaggcagaactccctttttctttggggacattggtctttttctcttaaggccttcaactcattggataaggcccacacatattatacagataatctgctttactcaaagtttactgatgcaaatgttaatctggtcttaaaaagtacctgcccaacaacatccaggcatgtttggtctaatatctgggtacgtacctagccaaatggacacatcaaattagccatcacaatgtctaaaccaattactgagaagaaagagaccagaatcaccattgttggtataaatctcagccaagagtaaccctctggggctggtaaggggctccttccctgagtatatgatggtatggagggcgaatgtgcaagcatagtcagggctctgcctgcaagacagactctagttgtgggtaaggtcagaggaaggcataggtttgagcaggtaaacaacatctgttaaacacttaggcaggcagaatcccaatactgtgttgcctcctttacatgtataaaccctgttggagcccttgttaccctgagtcatggatttatggcttatcttcctctttagactgtaggctcacctttgagtaagaatcatgtgtgagttacctgtttattaaccgcccaaacttggtgctcagcacaaggtaggtactccataaatgctattgaactgaccaaagtggggcatttgcgtgctgaattaaccttgtactcaccattgttatagagctcatatatttttatccaccacagctttgttgaagtcacagattcacaactgttatgccaactgactattatttctagacacttcagtgaggaacttatgggacgataaaactagttcagtcatatcaagttctctcctatttcacacatccataacctgaaaaaaatctcagtaacaaattgaagaacactcttaactttatagtcaagtaataagaggtaaggggtccattgtttgccacaagtacccactcagataaagtaggtcatctggagtcagatgttagagccccaggttcagttgcttaatccacaaattctcatgactcttatccttttcaacagagttggagttcccaaaagtttagaaagtggaatcatcagataccaatcttctctaccagaaagacaaaaggctttagacctgttaaattcagaggatgaggaagtcatcttttagttgtccactgtgtagaaacccttgaccttataaattcaagcatcccccatgtttcaggcatcttgagaaacccttacacacattattacactatccagtttgtaattgtctccctcaagcagataccaacaacaattgacatatactgactcaacatgcaccagacatgaacatacacacattacctccattatgcaatttaatcctcagcaaacctcacaaggctgatttagtccttatctccattttacagatgaagaacccagggagctgagctgggtaggtaacttgctgacagtcctaccaacaagaaaccacagaacccagactcaagtcccatcaactctgacttcagaggccatgatcacacttgcacacgttactgcttcccatgtagtaaggtttacatatattatctcaattaaatttgagagtgaggaaaagttattttatatcaacatgtaaggggacaataaaaattatttcctgtggttgtcttagaagcaacaaccaactcaaaatagggccttgaacactttaaagaaagaatgtgacaacagagaaaaaaacatcgaaaaatgtgaggcagacacacaacattttgcagtgaccacccagttctacccatgggcatgtcaatcactacagaggatgttctctttacaggttgtactaacttagcaagacttcttattacctggagagaataccctttatttctctaattccatactcaaaaggtacaagaatataattataaatgtaacttctgagatatcttgaatataacagatttcctaggaaaaaagtatgtaaacattctatttctttaaaagggacatcctcaattgtaagtattgaatgccatttgtcaatattgtttcacatgaacatagcttgtgccaatgaaattgttatatcattagaaacctggtcatttctagatgaattaatcaagttcggtttctatgttcactgggccatagaatagatgtgccatagtaaatttatgaagttaataatattcatttctgaggctatttggcagccagttggctttttcctgggtcacccactctcccttaccatgcctgctttcctccaactgcaaagcctcacgagtacttataattgccccatcatacaaatgagaaaaaatgatgctcagaggggttttgtgacttgcttagctctgcacagctggtgtaatagactctacagaaggacaggaaaagaagacatagaagccaagaatgaatgaggtgacctgggactctgctctttctatttgccaccaactacagagacctcaactgacatctccagccctctgctttcagtgccggagtagagattgcacactggctcctgctgagagctttatttcttattctcacatctgagcagttaaaaatactttgaaatatgtcacctgccttcccttctatccttgccttttgcttgctttttctcttgcctcgctttactaaagcagcaaaagcaagaggaccattaaaagcaagaggaccataatgagggtaagagtagtgggaggagacacagggaccctccaccttgcttctgaacgaaagtcataatataatccttgctttaatctgtattcagttctctgtcctctgcccgcatgctgacaagatccactttacctggtatttttagctgatacttggcgcgatgtgctaagtgctggccatggatgctgctaaagtgacagcatgtgttccagcagctccattgccatggtcagtcttttcatagttcctgtttcattaatgttaagaaatggctcttccttacttaaccaaatgtcagcagacacagcttcggcccttaatcatccatccccctgcccctgagggcatcctatagattgaaggacattgagactgcaggctcagatggaaaaaaaagtaatctaattgcctgttacttaacaaactttgtcttgatggagtattcattgcacacataaattagactgcctcaccttttgcaatgtaaaatcctggaaataatgctagccttcattctaattgtttttaataaataaattaaagaattaatgtgtacttacctggaacaaagcttccctggaccacctccttgtatgcccaccagccttcatggatttttggtgaattctgttgagctaaaggaaaagcaaagaagagagattaagatgatagcagagaagcactgtgtcccggctgtccgagtaagaagggtgaatatccataaaataacccttttctaccccaaagtcatactacaacagaaccttccttctcccttcccttttttttttcaaatagatcattgatcggtaaatataaaaacatttttattgaaagttctctgatattttaattgatgttaaagagatagtaattatgtatttaagtcccctgctacctgtcctcatcatcttccccatacacacacacacacacacacacacacacacacacacacaacacacacacagtgctcctgctgaaactgaggagacagtaggcagatcccatccatgtatgtccatggaacccttgttttgggagagattgaagtttgctgagggagccagtctggaaggctgaaaggtatacccagccagctttccttaggtcccaggaaaatgaaaacaagaatataaataactgtggtggaggtttttgacatcacaggcaaaaagggcagagggctcaagatattggaaaatatcgtggagatctgtaagctcatgctgacatgacctcagggaaacccttgaattcatgacagttgacaagtgaattggggcaatgccattacacatgcacacaaaccccaaagtatacatgatacataaatttatgcttatccctttattaaactacattcatatttcaattcccagacacattggaagaaaataagtgaatcaatcatatttgtaatttggctactattaatgttaaatcttaacttttttcttttcttctttaaatctggtgggggtttttttccagccttcctcttcaaagttctagggaaaagactcatcattctgagttagaaagaatgggtataagacaatgggtttgaatgcaaggctttgtatagagagaagatttactagatttctctagtttccagataagcttggactgtttagcttcaagtctcttcttatagtatagtgaagatactttttcttcctatgatattaagagccctgaggcttgtatctttgtggttgaaggagattttctgacataggatgagtgaaactgaagcccactccttctggaactgacagtgggcttaggggactttaaaaacaaataaaagagagacaaagagcttatttaagactctggaaaaaataacacctttaaatttgcccagcacaaatctcaggcatggacacacaaaagtatcctggatttcctggtattcttattgcccctgtggtgtggatagagttcagacatttccatagcccttgaggaagatcccgaggtcagctgagttggaagccaatgcatctgctctgggacagcaggcaaaggaggaagtcacctcaaagcagaagccagaaaggttctgtccaaccagggagtcaggcggaagattcaactgagactctgggaatttgcagcaccagggaaagacaaggagatttgaagtcagccaggaggtctttagacccgaccaagccaagaaaccaaatcaaggtttggatatggctgcaaaattccccaagtgggtagacaacatttctctagagttcagaaagggttctgattcttcctctgggtcttggtattgcctgactcaccctccttctcccccaattcgttagacagtcatcataggagccagaggagaatcccaaaggcttagaaacctgtgagatcagatatctaatggccctcttatgaaacaactactttgtaatgctcaccttgagtataattaaataaaattcacggacagtacaacctactaaaaaacaacaacaagaaaaccaaaccccaaacctgataattctctaaacttcagcctagctctgctagacatgtaaaatgtctcaagcctgggaaaaatgcatgtttctaagatcttaaaagcattgaactataaacatcacctaacagttttgcatcagagataagccaggactggttttccttacaacaggcaaaaacttcagagttttataaaaactcacaccaagttttatccagtcaggattactgactgtcatcaaacaatttaaaccataaatccagccttctctctttattctacgagacagtcattggggaagctgcattatcttgcatgtgtttcattaccccaaataaatatacacttagcactcaaattttgttacattaagctttttacctaattattttacaaaaaaatttttacagtgtttacacatcactttaaaaatttaatgtagtgctttaactataaataaaagaaatgtaatttataataatatatatttcaatgtgaaaatgcttgagtatgatacactagaacagagattggaaaacttgtgcctgctagccaaatatggcccattgcctgtttctgtactgcacaagagctaaaaatgaatttacatttttaaatggttgaaaaaaaagggttgaaaaaaatgttttgacatgttaaaattatattacattcaaatttcagtgtccataatgttttattgccaaatagccaaacatatttatttacatagtctctagagttgctttctcactacaatggcagagtggaatagttatgacagagaccatttggcccacaaagcctaaaatgtttcctccatggctctttactgaaaaaatttgttgagtgctaatttacatacataatttcaaaaggaaaaacaatcaatataatcaatatagtgctttaactataatacaagggggaaatacaaggaacataatgtaaaacaaaatattatatatttcaatatgtaaatacctgggcatggtgcactagaagaagataaaatgaagaagttggatgcttaattaacacagacacaaataacaacttcatattatattagagattccagaatccacaagtggcatttctctcaatggtatgtggttttccaaaatagtgaactcttgggaaagattagaacacaattaagtaccaccttctcttgatttacatgatctttgcattgctaaagaaccaggtataataaaactttgtaagacatgctttgtgtgtatatgcaaaatggagtttgattggagggtcaaataaataaaacagtttttccaatcacttgaatgtctgttgggacatgggataatttatcgttgtttctaactatctaatatgttgcagagcatagcatctctgtccccctttagttgttgctaattgccactctttcattataacaatcttaagtgccctcacccatttccaaaatattcccccagaaacggtgacatccctattgacagtcactgacctaaaggtgctatttatagtacttacatgtgctaaaagaggataaaatgaaacattatgttgaacactagaggatagcgctttgtctaagtagacaaaagatacatctttccccatctatctgaattgtagtgtcatatggaatacatttgccaccccattaccccattatatgttcaaatattttttctactctttcctgccatttgaccatatcattaagaaactttcatttctacaagggataaagcagtaaggaaaaaagagaaagcatacatgcatgttgtcaagacggcaaaaaagggaaagctaactctaataaaacctgagtaagatgactaggttctcagatttttagatgcattcctagtccctctttttatctctcttcttacatgtgcatatcttccacactcccctctaaggacaacctatcagtcgaactgaaatatcaatttaagaaacatctatctagaaggaagaagaaagaagcccctgggtaagtaagagtattggcactgacaagattatcaccaaaagcttctgttccatccagaaagttgcaaaacactttgctctttcttcatctccaatcattgcttctttggctatcacatccattcagaagcagaactatgtaagattttagcaggtaataagacaatcagaccatctgaataaagcctattgtaatagtagaactgcagagctcctgttagctgtctttgatgtgcattgtgaagaaccaaattcaccctccaaaaatcaatcagctggaagagcccatttgatgtctatcaattacaaaatttaatggctgcagactagaagaaaataaagatgatttatgtaatgttttcaaattcccttggatgctcaggctggcctcatactgtttggtaatttagaaagacaggatggcacatttaaaaaggtacctcacttaaagttctgccacagtactacaagaagtttattatagatggatctcctagagaaatacaggattcttattttaacgcctcccaccagatccttggtagtcatcttgttgttgtttacatgtgatttgaagtgagtgaagagctgattgagaattcctcagagcaaacaggtgaacagagagccgcctgagcttttacagcattctatgctcctctttgcctaggtatggatcagaattttttaatgtgcaaccagcccctgggaaaaatccaggtgtctaattaaaaaaattgtgttgacaataaaaattgtcatcactgccagaggaaaagatatacatagcaaggaaaaatctatttcagttttattcttggtttatttttcactgtggcagtttgagaactgatgattttccaaaggaaactctgaatctcagaattttgagagacaatgttcattgctccaatggcttcttatacaagtgagcagaattatcttacataattctacttctgaatgaatgggatagctgaagaagtcatcgttggggatgaagaaagagcaaagtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcaggggtgtagctgtgtgccagtacaattttatttatgaaaacaaagagctggatttgatctgtaggccatagtttgctcagttctgtcttggatctaaaagatttttgttatccagttctgtttcttacttaaatgttcagaagtgagctactttacaaaaaaaaaaaaaaaatcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgccaaccaacttaaaaaattatgttcatatacccactgaccacaaatacaggcatcacaccaacaagtctttggatccagactaaaacttcccaaagatgatgtgatctggcctgtgagtagatccctatcattaacagagcttactgctccaagtcaactaatttaactaacttaggttcagagaaaacataactgcgaaatacctccatttggaaattacagtggtctcttgacctggtgggaaacaagacttaaaagcaacatctgagatagcacagttgaggtagggaaggaaatggtgcaatagggaacagaagagccctcacaaagggatccagttggggaagggatgttgcttaataaaactccaccatcagtcaaaacataccaaaccataagcacatacattgcaaaaataagcttccaagccctgggtcagtacaattatacctgtgccaagtggtctacaactagcaaagatgaagccagatatagaggagaggcagagtacatacactgctatggttacttcattttaatgtaatggtagaagccctgaatggttgtttccctcagaaattgcatttctccactggaggaggtaattcaaggaggaaggtaccaagtctactgaccaggaaacaacataagttggaaggtaaaaaagtacttctaacattggatgcatatccatgacatcacttctttccttgcatggccaattttgtgttctaagtgggaagcaggaacattgagaagtgcatggatcgtcagaagaaacataaatgactgccccattgagctgcatggcactcactagactaacggggataatgcccttcctcaggtggttgacttttacaacacccggaaggtatttttcttctgtgcactctctgtattatgtgtggtcctacattctaacatttagatagtgccccacactatctgtttccatatcattcatttccacctaaccgtaaccttcctgaggtcagagaatatatcttattttaaaattccattatttggccgggtgtggtggcttactcctgtaatcccagcactctgggaggccggggcacgcggatcacgaggtcaggagatcgagaccatcctggctcacacggggaaaccccgtctctactaaaaatataaaaaattagccgggcgctgtggcgggcacctgtagtcccagctactcgggaggccaagacaggagaatggcgtgaaccggggaggcggagcttgcagtgagccgagattgcaccactgcactccagcctgggcgacagagcgaaactccgtctcaaaaaacaaaaacacaaacaaaaattagcagggtgtggtagtacattcctgtaatcccagctacttgggaggctgaggcaggagaatcgcttcaacccgggagacggaggttgtagtgagcagagatcacaccactgcaccccagcctgggggacagagcgagactccgtcaaaaaaaaaaaaaaaattccattatttatgcaaaagcttagtacataataagtgccagaaaaatattgggtgaatgcctgataaacgtggtagtgaagttgtatattataccaacttgcagtccagctcacacaatccttgggaggttttagtctctatccaaagacttgtgggtgtgacgcctatatttgtggtcagtgggaatgtggacaaaagtggtttcaagttggttgacaagcccacacgtgcttgacagatggaagagtaccaggagctgacaccctgcctagggaaatcaaagccttagcaaacccacttttatttagcacaatgtgtttcatttaaaagcaaaggggaagatgtgtcatacctggaactatttacatctctgtctttctttgcttttcctgaattcgcaagacaggatgaaactcatttctatctctccatcctatgtgaaaaccccacttgccatacaaactagacaggacactcagaacattgagaattgaactggttaatgggtgacaaagtgactatttccaaagagagaagatgggtatgacctagaatcaccttgcgtgttggaccagacctaagcaagctgacaaaattatatttgtgttgggagataagaaaaaaatattgatggcgggtagcccgtattactttcatctaaaatgcttagcatgatactatttttaagaagttcaaggccaggcgcagtggctcacgccactaatcccagcactttgggaggccaaggtgggcgcatcacgaggtcaggggatagagaccatcctggttaacacggcaaaaccccgtctctaccaaaaatacaaaaaattagctgggcttggtggccggcgcctgtagtcccagctactcgggaggctgaggcaggagaatggcatgaaccagggaggcggagcttgcagtgagccgagattgcaccactgcactccagcctgggtgacagagcgagactccatctcaaaaataaataaataaataaataaataaataaataaataaataaataaatattaaaataaatagagagaagctcaaaggtaactagacttgaaaatcatcaggaggaaagtccctattatggctaattctcagcctagtattctagaatttctgcaatttgggtttaccacacatttaatatcatttctcataaaatttacaagagtcattcttcctgctgtccccaggtataccacgtttattactctctccacaccttcactctgccctttttccccccgaaattccttctttgtctactttttcttgacctggtcttactcaattctcaaagcctctccaatttacactcctttcaagaaaggtgtactgatcattccaactctactgtaatccctaacttccctgaatttcagaactttagtgtctattcctcatttgccattcctgttaattcaagaaacatctagtgagtacctatgattgtcagtaagtattctaagcattgagggtacaaagttcctgttttccatgaagttattaggtgggcgcaaaagtaattgtgggttttgctgttaagtaatggcaaaaccattaacagcaaaacccacaatcacttttgtgtaaacctaatacattctccgggagggagacagagaaaaggaaagaactgaattcaaatatataagaaaaattggagaaaagtactctgtgatatagagggtgaggtagtaaagtgactagaagaacatatgagattgtatgacagtgatggtctctgaaattatgacacttaatcagagatttaaataaaaataattggcttcatgaagatcagcagtggtagtatttcaggtggattcaaagactgaaagttggcagaaataagtttggcttctttaagaaaactaaaagtggccaataggtgtgataatagtagatacaggggagaggcaggctaaaaatgaggccggacaatgtaagtagcggcccaagagaaaggtggtggtggcttcaactagggcagtgctggtgaaaatagaacatcataagatttagatgaagcggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgttaacctgggaggcggagcttgcagtgagccgagatcccgccactgcactccagcctgggcgacagagcgagactccgtctcaaaaaaaaaaaaaaaaaaaaagatttagatgaagcatggataagacttggtaatgaactggatgagagaagttgaagacttctctcaaggaaaactcccaccctttttagtctgagtgactagatgttgacagttactgagatgaccagggagactaagggagtaatttgggagcatcttcagtctcctcatggctgcaacactttctttgtatatttttaacatatattttgctattacttctctctccctgactaaattaaagctgtctcaagggtaaaaatgttgtgctttgtcttccataatgcaacacatatcgtaggtacactggcacagtgtttgacaaatatttgcttaataaatctaggaaagggagaatgacatgtgaacctccatttataaatgttatttacaagttttatagaaatattcactctgatgactaccctctatgatttccttggaataagtttaatgataaaaggtccttagaattcaaagaagagtgtaactcaataatagtggaacacaaaagaaaagggacaaaaagattacctctaatctctgtaattttaagagggtaactataattttgcttctttcaccaaacattacgtcttgttttttcattcttatttttaatgtacagatactagttattttagtagctatgccataatttaccaattattccttccctattggttatctagttgtttgaatactgcacttaaccttctcaggtacaaagcttccctcactcatcctcttttagacctttctttagcacagtgagccaaaatcacagtcaagggacagaagtatatatgttgagttactttgtaaaaaatgttataacaatctgcattgccacaaaagtataaattattatttctcaaaggaaaattctggtggtactttcaggataactacataataaaataatgctaaccatttaaatataattttgacttctgacaaataggcaacttaagaagcatcattagtctaatgaatgaatctgttctgtcatcagctcatgagatggacatttcatagaaatctattccatatttttactattatttatctgtttggaatcaggtatagatttattctctgtaaatattgtagctcctttttgtagtagagtgtatttatgtttttaaacagatggatgaaacttcagatcccaagagtacaagtccatgcctaggttcatgcagcctcccataaatcatagcaataaggaaaatgtgtatgtgctatattcagaatgctaggagcatactaataactccatttttaaactacaattggaaataaactactggtaattcctaaaatcaatgggtcagtcaattgtggggttaatctcatgtcacataaaactttctattacagctgaaatctctgaatgagactaaaatctccttgtatctctcttaagcttgaattcagcaaggctaaatgcaacgaaaagaaagaaatccagcagaattgttggtttgggaggcagtgtgaaatgatggaaaatacatggcaccctggggttaaatcacaaatttgctactaattgtgtcactttgggcgaattatttcatctctttttaaaaaatgtttatttgtataaatttaaaaagtacaaatgcagttttttaaatacagatatattgcttagtggtgaagtctaggcttttagtgtaaccctcaccttaatgggtatattatactccttaaggaatttcccatccctcatccccctcactctcccacccttccaagtctccaatgtctattattccactatgtccatgtgtatacatttatagcttatagctctcacttataagtatttgtgatatttgactttctgtttctgagttatttcacttaagctaatggtcttcagttccatccatgttgctgcaaaagatgtgatttcattcttttttatggctgagtagtattccacggtatggatataccccattttctttacgcacttacccattgatagagacttatgttgattccatatctttgctattgtgaacagtactgctataaacatatgaattcagttatctttctgatgtaattatttcttttttagagtagatacccaatactgtgactgcagattgaatggtagtctatttttagttaccaagaaaactcctctaaattgtgagccaacttgtggaagaaaaaagatagccctccctgactgaaaaaagacttaaagagcctctgaggacattcgtgccatttgtgagtcaaagtacagtcactgaagaaacttggggaacagaatataagacttgcagcaggaaaaaaactgattcagggaactcatgcaggaaacatgtggtcttcgctgggacaaagcccagagaaagcccaatgcccggtagaaaagtaggcaaaatgacctattaagtcaatttgccatggtgggacataaagccacatgcaaaccataggaaaaggccagggcagatttattttttatgtatatcatagctcaacatagttttgtccttcattctgattctgatccacacagcatttgctgagcatgcactatatgacaggtgctgtcacatacttataagtggtagagccagtgaattatgaccatatctgggctttccacaagccaaactggagtttcattatataaataaccaagaccaaactaaaatttggaacttgaattgtctggagagttgtatctgaggagatttgaggaccatccctatctcagctactacttcaatgaggatgattctcaaatttatattccccacctggattttttattccagttccatgcaagcttttcagcagcctactaattagaatactgctattttccaggacctcatgatcacaactgtcttctgcccctgtggcaaaaatagtgctactaaatctcccaatatttatttccccttcttccttaacaaggaaaactctggttttagtaagacatcacagaatacagactatattagccatatctcctttgtaggtaggtgtggacatgtgaataagttctggttaatgagatgttagaaaatgtataagagttccaggaagtgctaaaagaaaatgctatgcctctcctcacctcttccagcaagccgggatgtggacatcatagctagacttcaaatagccatcctgaaccatcatgcaaatgccttattttcagcatcaagatagaaagagctgggatccctgcatggcctacatttataagatataaataaatctccatcttatttagacttatccatcactcatagctgaaactaatcctagctgatacacacttgccttcaatacccatggagtgaagacattgactctacttctgctatagctctaatccattctttccttcacatttctactgcctagacacagatcctagacaaaggccctcagtgattacttaaatggccaattatagtggcctaataactggactcctatgtccatccatgctccctgctgtggtcttcacacctcctgcatgattatgtttcctgtttacagcagcactgtgtccatgtcgtctttcacttttgaggggtagtgaaagacatgcacagagtcttcctatgaagctcatttaccagctatttacacagccaggtccaaactcattgaccatctttcaagtctctctgcaaagcccttcaatgactccctattggttacacgataatgtgcaagtgttccaatgaaactttcaacaaactgtatggtgtggttaacttatctgttttccaaaactcatcctatctcctttgggcatcttttctctgtgctctcatggcatttattatatacatttacttataacatatatatttttcttaaataacctcttcatgagattgtcctcctgtcagaataggtgccctgtaaatgtatttggactgaagtaaatttagacatttgtttctcactgaccaaccctagtcagactgaactatctgctcttggtgatgtttgccatgtgttcacactatttacttttactggaatatcatattctttactgtatatccaaagtaaaccaatatttcaagtgtttgctcaaacactaccttctaaaaaccttccgtggtttctccagataaaagaaagctctattataatctctgaagtttcttaccatattgtatacaatttatttcatttcagtccaattcgatatgattcaattcaatcaaatccagaaaatattaatatttagaacatactcattatgtttgcatactcattctaggtctttattttggagtggtttacagtgcaatgagaaataaggggatgtctttaatatattctaggctaaagtgtatgcaatatacaaattaagataatgatagtgttgacaatgctagtttacctgcgagaacaggcaaactctaaaatctcaatggcatagtacaagtttatttctcatacatataaatttccaaactggttttcctgattggcatatagctctccaagtcagggcccaggtttcttctgtcctgtggctctgctatctgcaatacaagacttcaaaggccgctatgctgtgtaggtcaagccagaatggaaaaaagcgtggaggatttttcaaaagttgttttcctggcttaaacctagaaataatattcactacttctgcccacatttcattgactagaacttggcctctttaatacaactaaatgtaaaaggaggctagggaaatgtagtccagctgtggactacacagtggtgttggattggatagaactgagggaagtcttgtagaatccctcacacacaatgacactgaagagaatttgaaagttttccactcccttaaaatggaccaagaagaggagtaaatattttttggagaacatgcagccagagtggttataacttctaatttgtctagaatattctatttgcatttgttgtcccaatattgttataaaatggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcctacaacctatctctttcccctgctttcttactcaccatttgccagccaataagtcaatacaaacaactcaattggctacagaagacacaattactagaaacctgatgacccagataccttttcttgtaattaattaattaattaatttttgagacaaagtcttgctttgttgcccaggctggagggcagtggcctgatgtcgtctcactgcaacctccgcctcctggattcaagtgattctcttgcctcagcctcctgagtagctgggattataggcgtgtgccaccacacccggctaatttttcatatttttagtagagacagagttttgccatgttggccagactggtctcaaactcctcacctgaggtgatcctcctgccttggcctcccaaagtgctggggttacagatgtgagccaccgcacctggcccctttccttgtatttaaatgctagacaaaaagaggcaaatgtcaagaaagtaagattagagaaattaaaggttcagtggtagaaggtatggagaatggttccttcttccctgaataacttttcttcaacagcaaatattcaacatgactccctatgctgtcttcaattctgttctatacagtgagaatagctgccggaatgagttgtattacaacatattgaatataataagttgtaattatcttatacagaaattatttaattacatttaattttctcctaaatatgaaacagcatgttcagaaaaatgaaaatacaacatagaattatacatgtgaaagggagatttaagacagtgttttatgccccccttatttatcagatggggaaacagagtcctagaggaataaaaactttcagaagagttaacggtagaagccaacactatgaggtctctggtgaccaaattgctgctctatcaactacatacaaaaggattttaaaaggagctgaaggccattatccttagtcataggaccagaacaccaaataccacatgttttcacaagtgggagctaaatgatgagagcacatggacacatagcagggaacaacatgcactggggcctattggaggatggagggtggggaaaagggagaggatcaggaaaaacaacaaatgggttctaggcttaccacctgggtgatgaaataatctgtaaaacaagccctcttgacacaagtttacctatgtaacaaacctgcacatgtacccttgaacttaaaaaaagtttaaaaaaaaagtcataaaaggaagaattagttgtcagctaaacagaacatctgaattcagttatttaggataattagttcagtagtcagcaaactccaaagtttttaaatatcacatgcagtcattctacctaagaaatgtgtaacaatgagattctgtcttgttggcttatagaaaagtgactctagaggagtatgtgcaccctgtataggaaaattgagtggaagaacagtttggcaagctcctgggtcacaagttacagtaagcaccttttgttcttccattattcacctccagcactctaccacataacctcaagatctactcactttgtacatcaaagacagattattacaaatgaaaagaatgaaccaataggaactgctttccttgagatccccctctaaaagttaatctttcaaggaacaaaggaaaatgcacttcaaaataggcattttccccctcaaacaataggttttctcaaatttctgagaatgccaagaacactgtgtttttgttataaatgttacatgccagcatatgattacaaaagcaagaaatgaaaagaaaaaaacccttacactttttaaaatcacaggtgaggcagatgccatttgtaagagctacaacatccttaactttcagaaaagaaaaaattaccaagcacaaaagtgaaaaatacactatagattatatacaaatctgtcaataaaatgctttcatcatggtggccaggtttcacagattatgctttgtttagaaagtaagcaattccatcattaggctaatgctccacagtgctacaattctacttcctttggaacaggcaggatcatgtaatcacgaatttcaaaagatgggcaaaaccagacacagaaaacgttccacatgctactgatgcaaatgttgtactctaattttcaaggtcaaaaagataggataggaagattacagaagtgtgcaagaaatacaccaatattgaccttaactgagtttttgtgtcactatgtgtacacttactatggtgttcaatgaaaagatgctggtcttggtgagtgtacaatgtgtgaaagtgtcaccacagggaccaagggtgggctggcattaggtcttggacttgagttggattccaaggttttcttagcagccaaaagttagccaagagaagaaataaaaatagctaacatttaaatagcttttataggaaggcactgttctaagcattttatatatgtattgactcattaaattcacatcaactctcttttgtgttacagtattcctgccttctctgcaggggattatgttccaagaacctcagtggatgcctgaagtctcagatagctggtgactatttatactgttttttttttccctctatacgtagacacttatgataaagtttaatttacaaattaggcattgtaagacattaacaacaatagctagtaaacaatagaacagtgataatatgaaatgtatatatattttatatgacatttataatatacatattttaaaactctcaaaactataaattttatgcatgcatgcatatgtggtaaagttataaaaccatggatacatattaacttggagaaattggttctctatcttgagaagaagggagagatggggaatacaatttggaaaggatacacagattactaaaattttatttatttgaaaatatcagaaacaaatatggcaaaatgttaatatttgctattttagaatgatgagttattagtatttcacgtattctcagtagtttttccagtatgcttaaaagaagccatgattttaaaataggcaaggaaaaataggtatagttgtaaacaaacaagttattaagtaactgtaaacgtgtttttaaaaattagctagaaaaaagcaacctcagaagggaagagtaagatagataaatcagtaagatagagatcagtgagaatcttcatagttcaaaagtgataggccaagtaggcgtcaattcttaaatagatgtagttttaatgaaatcctaattcagtaacattaagggattcttcagtaacttaaaactgtttccaaaattacatggaagaacaaacaagattttttaaaaagacttacttgcagagatatcaaaactttataaagttataataactaatatgatgaggtattgataagtaattgacagatcaattaaacagcattgatgatgctgaaatattccctagcatatttttgtataagatataacggtgtaaatatcaaaatctacagcaaagaagtggactatttaacaattactaagaaaattggctaattgtaacaaaaattattatatttgtcataatatacatcctggatagatttaaaagttaaatgtaaaatgaaaattttaaaataggtaaatagaatataactatttttttctgtaaatacagcatctttaagttaatgtaggttcctctttgtcctaaacctaagggttttttatgcattctaggtagaccagcagtctaactctcacagaacattcagagaaattaaaataaattctgcccacacccctacatgagatgaactggaacgtggtgtaaaactgggttacagatctatgtagattatctgatgatctgggcttctttaaaggaaagataagtggataccccagggaagttaccatgaaccaaggaagacaaagatttatgtaaatagctgctgactacacactctttttagtaaacttacaaataacaggattttgaacaatacagcattagctaaatatattatggaacactcacactaagaaatattaaataatgttttttgaagattatgtaaagacagaaaaatcctcaccaaaaaatactatctgaaaaaaatcagcatataaaaaagtatataaaatatgatcctaattttgagaaggaaaaaatatctggaaggaaatacaaccaaatgttaagtgaggttattttcaagtgttatgatgatgaagtgaagttaattttctaaccactattttccaactttttgtaatgtgtattttttatgattaggataaaaatggtataaaaatttttaaaaaggcaaaacctcccactgtgtgctgagcttccccgaaccagtgaactagatttcactgaggaccctaacaacttctcagtggtaaaaataatgagttttcccaacattaagatttaattttcagtggtatagatgggagcaagaaagcccaaaggacattgaccgtttctgagcctaatttctcactcccgcacattggccactgtgctgctggctaaacaatttccccccattctcagttactcgttttgctcatgcataaaagatacatgttaaatcagagaaaccaccctaagggtgattgatgaggaggacagcctggagagttacttcaagctctaagctcagggaacttggtaacactttggactcaattttgatttgcagttgtacaagacaatgaacattgctgttggagggggaccttgctgtatacactagaattcaatttagcaggaaatggcaaacactttagggaacccaaagaccatctccatgatacagggtttcctaagaggacttcctaagagggctgcacaatgaaacgaatgtgccctggaaagacctgctttctgcatagccagtgaggttttataagccatgggtaaaatgggataaatgttacctttgaaaagtatatgccgcctatgctcttcacatagggcttctaaatcactacacaaacttctacataccgatatatctttctgtgggagggatgagttaaaacaacctgtctttctctttctctttctccgcctgtctgtctctgtatttgtccctgtctccttctgactctctcctttgtctgtttctccctcttcgtgtgcatttctatgagtgtctgtttgtatttttctcagtgtctatctctgtctcattctctgtataacattccttctttcttgtccacagaattttttcttaaaagggaaggggactaatatagcatttactttttctggcactatgttactttatatacactatttaattcaagccattcagcaatcctaagaggaggaaaaacgtttttaagaaaaaaccaaaaacttttcttataaatcaggaaactgaagcttacagaagaattttgtccaaaggccacctattcacagaaaatggaagatggctgttcggtaatgagtccccgtggaccccggagtaacacccttcttagtatgtggacatgcttgcagagtgcaccttctccgtgatacaaggctattcttcctaatccatgggctgggaaatccatggcctaagatgcaaactgacctaacccacaggtataaaggcagcagagcaaccagccctccatccttcccacctccattcctttcctgccagctctctttttcacttcctgcaacctgattttcattcctgagacaaaataaatgtatccttcacagagttttctgatgttgaggacccaatgtccttcactcagtccttactgtacttgctctctgaggattgaataccatggagctcatcttcttaaactgctttttccttagcttctgtaagataatatggcatttgatttctatctattctctgtaaaaaataaaaggtaaaataatttgtctatgtaagtcctcacttaatgttgttgataggttcttagaaactggaactttaagcaaaacaacgtatagtaggtccttcaataatatcatttccttcaatgtaatgttttatcatgttgacgagaaaaaaaattggttttgtttatatgttgtttcacttaaagtcagtttccaagaatctactggtaatattagtgaggacatactgttcatatatgtatatatgtgtagatacatatgtacacatacatatatcagggaagtaaagaggacatagttggggaaaccaagcaacatagagatgggcacatactagctgcttaatatattaatttattgaattaatgaattaaccaactcatagaattatctcccaatcttcatctaagcaaatctttcactccagccaactagaaaagtgccccctataaatgcaatgtgttttcttgctcacattcatagacctcatctgaggtttttccctctttgtacaaatgctatttacatcctgaccgaaaccatcaccaacccatggaaaatctcctttgttgctgtgaattgaaacaactcttcctctctaaatgtttatgacaatgttcacctatttagcaatttatcctttgcttccctgtggggtttttaatcatcacttaacttttgtgttgttatttcactcctctcttgttgtcattgtctcttcaactaagagaaccatacttttgtgtcttcattgtgcccctctaagagaagatgctagtataaataaatgtttaatttattaatattttgaatgcaagagaccagtgctcctaagtattgctagcttttatgcagtagaatggaaaagagggcaataactaaattttctgagagtctcctctgtactagatgttttgcaagtatatcttgtttcattctcaccagaaatttattaggtagtttttaccttatttatacataaagacactgaagttcaaagttacttgatcagggtcattcatctggtaagttggaaagctggggcctgaaagcaagattcagctctaaagattacatccttaagatgagttcatgtcctttgcagggacatggatgaagctggaaaccatcattctcagcaaactatcacaagatcagaaaaccaaacaccgcatgttctcactcataagtgggagctgaacaatgagaacacatggacacagggagcggaacatcacacactggagcctgcggggtgtgggggctgggggaggaataacattaggagaaatacctaatgtaggtgacgagttgatgggtgaaaaccaccatggcacatgtatacctatgtaagaaaactgcacattctgcacatgtaacccataacttaaagtataatttaaaaaaaacctaaataaatgtataaagcaaaaaaaaaaaagattatgtccttaaaattgtgtcacactaaacaataaagtttctagaagaatacataggaatgtatcgtcaggaaactggagtaagcaaaggcttcgttagcaggacactaggggaaacaattaattggacttctttaaaattaaaaacttctgttcacctaaagatatcacaaaagagtgaaaatgtaattcatgagttgggagaagatatatacatccaggcaaaattattgaatttagaatatactgtatccaaaatatactcatacggtatccagaaatactttaaaacttaatagggaaaagacgaagtcttttgttcatttatgggcaagagacttgatagatccttgataaaggagaatatccaaatgggcagtaagcatatataaacttgctcaacactactcaaatttaaaccccaatgaaatgccactaccaccaccagaatggctaaaattaatacaatggataatagcaagtattggcaggaatgtggtgcaactggaattctcatatactgctggtggtaatataaattagtatagccactttgaaaatgtgtttggccttatcttctacagttgataaaaactacaaatttcatctactctatgacaataatttcactcctaggtatagatgcaaaaaatattagtgcgcatgtctactaaaacacatgtacaagaatgtttacatcagctttatttatcatagccaaagactgaacaacccatatgtctactgacaccagaacagagaaacacatttttgtacattcatacaatggcctacaaattacacattaaaagaatcaacaattcctaccttgaacaacataggtgagtctcaggttgtagagtgaaagaagccagacacaaagagtacattctgcatgatgttatttatatgaagttttaaaacaggcaaaacaagttcatagttataaaggtcagaatatttttttcctctattgggtgagggcgaagggtgttggtaattgactgggaagggatgggggtgaacctatggagtgatgaaaatgttccatattttgattggtgtgatagttatgtagtatatacatgtgtaaaattaattcatctgtacaattaagatttgtgcattttatatgttaatctcaatttaaaaagcaagtaatcaaccaaacagcactctgtcatggcaaatggaaatatatttgtaactataccagtttcctgaataagaatttatatgatctatccattttatattaataattaaggtccaaggaaaacatttgtctctcctgacactctggtaagattccctttatcagataataaaaccatatatcctgtcctgtctcacctgtgtcaggaagcacacacgaattcaatactaaattaatcattttagcctgggttttggtatatttactttcattctctctttctgctcctcactccccaaactccagcctcacttcccttctgatgaaaatgttttacgtatgccgttcagtacctcaaaaccatgttggatgtaggtaaggatataacatgacgtgctaaatgaacaaggtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgtttatgaactaggatatcccatttttaaaaaatctagaatggatgctgagaagcaggattgcttaattgtagagtatgcctatcttggaacaaattagatctctctaaagtggttataacaatttaaaacacatcttttggccacagttggtataatcacatttttaaatgtgtgtcaatagatgggtttgtaatggtatgctactgcaattttaatttcccctgaatcccagtgaggctgaacaaatttttcatacatttatggctgttggaatttacctataaacagtcttgtttatatattttgtacatcaaatggtttattagactgtttgaataattctggttccagaacattttacttctcccagaaaagctcaaccaatttctcttgcacttctaattttcagaagttttttaaaattgaacccaaatctgtattgttgatatttctatccagtacactggttttgcactctgggttgacacggaataagtctgacctttctttcatatcactgccttacatatccatttgttcattgacttattcattcattcattcacatacttactcatttattcatttcagcaaacacaaattaagcactcaccaaagtcaggaataaaacctgggtcaagtcatcaaggagacacagtttgatagaggagacagacatcaaattaactaatgatacaacatggtaagcccagtaatagtggtatgcacaagaaacaaaggtaggacagaatgaggatgactttaacagatattcaccctctcaccacaccatttattaaaatagacatttctataaaacttgcctgcaataagtatccactgtcatagtcctcttgtgtatctttcccccgtcacctggccactcttccagcggaggccccccaatatttctatatcaactaagggggtggcagggtgtgggagatacaccaggaccttatgcctgtgctgcagctggcctgttttgatgggttggtgcccagaactgctgttacatatttgactgtcatatttggaaggagctactttcacttgtgtcctggttacaggtattctcactgtcccaatcactctctgtcacatctatctttatccttcatacatgatagtgctcagaacaatacataggttcatggaaaaatagtctaagcacagtgtttatcaaacctcagtgtgtgcatgaaacatctacattttttgaaaaaattgtggatatgactcagaaggcctgggctggggcctgagattctgtatttctaacaacttgcctggtgatgccaatgctgctagtctgaggaccatattttgagtagcaagggtatttgcagcttaaaatgtagttgaaccaacaccaacataattctgacccaacaataacgacccagcccagtgtcaaatcagttatctgacaacagtgtcacactacagacatgtactgacctaagtcctgtactgacctaagtcctctaagtctttttaggaagagcaaaaaagtcaatactacttcatcttctatttatggagatatgtttttgtatacacgtatctctttgcagctacactagtttggaggctagtgacgtcgggaggggcctgtgatacctacctgttcctctaccgggccagtccatagagaaggtatacctagcatgcatccaacaatgcacctgagcttctttagctgtacaagggcccattgctatattaaagaaatcctccagggagctaaggctctaagacacatctttacaatgtttcattcattccttcaacaaatagtgcgtgagcattcgtacctggtggtcattgctttaggtactgagacaaagtgcttcctctcatggaatttatattctgctggggtcagatgtgctccaaaaatacatgaataaataaacaagaagaatttcatatggtggtgttatgctgaaaataatagcaagaggtgagggtggcagggtggctcctatggactgggcagtcagaatgatgtcatttaagctcagacctgcattattagcaggaagacgccatgtatagataataagaaaaaaaagggtcacaggcaggaaaatagatggtactagaatttgaagcaggaaagagcttaatatgctcacagactgggaaggtcagtaaactgcctggagcataatgaatgggggttgggatagaacacactgacattgaaaaggtagaaaggggttagatcctgctgacctacataagtcagggtcaggagtatagattttattctaagtgtgatatgtagccttagtgatcattgaggtttttggattttagaggtagactctgtaaggctccagatagaattactgggtagctactttttctgtttgtttttggcatcagcagtcagttggctgttggggtcacttacttggttggggaaagttgttgtatgggtgatgtttgaggagagaacacaagagtttcattggatcatggtaagtttcagatggctgccagtcatccacatgttggtggcaagctgactgttggaaataagagtcctgaagactcaatgtgctgtcgggcaagagcaaaagacctggcatattcagcagatggttcttaaggcatatccatagggaatgtcatactaacagattgatcagaggaggaaagaccagcaaaggaatttgagaagtggccagttaagtcagaggaagactgaagatatggagtcttgtgaactcaaagaagtgtttcaaggaggcagggcctgactatatgtgatgctactgtaaggtcatggtagacaagaacaagggaaaaccctctagatttggcaatacatagatcagtggtgaccttgatgatagtggccctagtggagtggtggggaggaaagtctgatcagataggttaagaatgtcagaaaggacgtaaaaataatgattgtagataataagctcaagattttatgtgaacggagtgaagagagtggtagttggaaggaaataagagatcaattttttaataggagaaccaagagcgtatttgtataataatggaaatggactagttgaaagggataatgtgatgattcaggaataaaggaagatataattgcagaagcaaagaccttgagaaggtgaaaaggaccgggatccagaccaaagcattaggattgatttctgataggcacagagatatcatcttcatagaaacagtactgaaagagacaggatagagatacagatagtttatttgggcagtgaaaaggtataggagtttctgtctgcctcaattttcttctatatttgagaaaaaaacataacccattctcaagggcaacaggactctcaaaaaaaacagacaagccaacacctagtgggaccccacaaactacaagtgaaaacaaaaacaaaagcaaaactctacatgaaagtgggcaagaaagaggtaagcaacttctgaacagagaaatggggagaggaaatgtgatatcctcaacagcataaaaatgtcttaaaattacggaactacgtcttatcctgtctcagttctcccacaccatttctgacacttaaaatggtgccattgacagccttctccccatatctggtctctcatgctggtatgctgaaactctcactcctcctccaaggaacatctcaaatatatcacccccatcaagcctttcctgatatccatcagtatcacccaccatcgatcttgccctactttgatttctcacagttttattacatgcttagtaaggtctttcttgtactgtattatagctttggtaggctttttggaggaaataatgatatcttcattgtctatgatgccttctaaatatttttcgctactctgacttacagtccagatattagctaatcctttgcccagataaggcttactcttttttggttctaagtcaatgtagttgcaaaattcagaccttcacatattcccccaagaattctagtctcgacaaccctgagaataatgtaagctgatgccaccattccctgctggcaggatttttttgggtacatgttgatggcctccagtaatgagatgcaagtgagagctaagtccccttctcccaacccagccactaggtgagatgctgcaatgaaaacatgtatctgactaatttctgcaacacatacatccttttattcatgagcatgtacacaattttttttctcatatgagatggcgaagcaccatctctgttaagacactttcaaaaggacccttgtatgaaaagattacttgaggcaaatgtgacatcatgtcagcagcagaattcagccagtattccagttaaaatcagccaaacaaattctctgttaagtggcaggtcataagaattattaaatggatccctaagcgagggccaccactagaaaggagcatacagcttttggacttgctagatcctcataccttatttattcaagggcagctgttcctgtgtgatgcttttgaccaatccacatgtcttgaagaccatccatttcaccaataaaaaattataatatttcttatgttaaccaacaaagtctctaggtagagatttaggtaaggagagttgatcacttgtcttggctgccattgaacggttgactactaataagtttctcttcagtgctaccctctggggtgtgtattcttctcaagggcacttcaaatgttagctattcctagggtatagataaaatcaacttaaacatatatagcatagggtttaaatagaaatattcaaaggtaaataatgaacacctaaattaataaatttctccctcccttttttctttccttccattttttttctctttctcttctgttcactttttccttggtcttccatactgaagagtgattgagtcattgtaaaggatattttggagtgcatattgtttccactaaaatttaaaatccacagacattgttgctctccaaagtccctccttagccaccctgacaccagcagctctgctttcctgaatcctgtcccctccacttgtggaatttcaaattactttcccatgtattctaactccctataacactctctcagcttttaacttgccaacctaaacaccaagattctcaggaaaacagagactcctccagagaattctggccggcctccttagaaggctgtttgtggaacatctttgtttactcaaacatgtccttgaggtctctaccttttctcatctccttagtaaacaactttgctgagcgattatttcaagcaaatgcaatgttgttaaaataaactaaaatggagaccaggcatgaaaaattctagagaagacagagataggccttgaaagtgaccttaaacttgtttgaatcgcaaccacaagtggaacttaacttgagctatttcttataaatgccaacattaagaaacatggaactttaactgaaccaatcaaaagctgccatctaacacagagttatgtaactagaagctttccagtaggacagacaaaacgaggcaactacataacccaaaccaatcagatatcttccttgccttgcttctgtgttcactataaaagcctccctcttgggcttcttcagtggaaccctgaaccacttgctgcctgattcatgagtcactgtttgcccgaataaactctatacaattttattgtgcctcagtttatcttttaacagtattcttctcaagaatgtaaataaaattttcctcaacctcattactaagaatgatgtttcattcttagtgtttaaaccttacaaaaggtccaaaattcatgtcatcccacatatattcttatgtacccttcaccctctacggaagtcacttactgttgacatgcatatacatcctcaagggctttcatgtattagattttttttttcctgctatgtgcacgcacttctcacttctttttgttgtccttgggtttacacttttagaattgtctcagcctaaggtaatcatgagaataacctggagattttgaaactacaaagaacgtcactagatcttttgaatcagagtctgagggttatacccagcacctgtgttttgtaaaaccatcttccctggtaatttttgtacacagccctaagtaagacttctccactatttagcgcaggaggatagcgttattgttttctttctttgggaaccacctgtggttagataattaaggcttttcagtgaccacaagctctggcacttgctccaggatcaactccctgccagtcactctcccagtcgtccacagcacaatccacagtgacttctaaggccagagaggcaagtttgcacttgttcacacatcatttttataccattgcttgtcacctgaatctcattcttgctcccccacagggagctggtcaatcttgctgaagagtgagtctgggtaagctccctcctaatcagagcaactcagtagtctgtgcctgtgcccgagactgctgacccttaaattagggaaactcaacatttgctagcttccctactggattaggtggccatgactgtttgatgctgcagctaggatgaactagggtgattttggcattgacgtttgtctttagtcacaaagctgggaactactgttggtgattcatatacacaaaatgaagggtgcagttcatcgcatttcttcttccaaggctctcatttgtttcaagttcatagcccaagtttctccttaccgcaagaggcagtccccccagcacttgggtggttaggtggatgacatgacttcacactggcatgggcgctgcctcacaccttagatgtttccacatgggcagactgatatagtgaagcaagctcgggctttggagccagactgatctaggttcaaaccccagctctgcagaacctaaagttctgtggccttgggccaatgaccatactttactgagattccatttgcgatccataaaatgaggataattaaaaaattaataatacctgcctcacaagtctaatggacttaagataatataaggacatctgttaggcaatcagcacctgctccttcctcctttggctcccatacaaaggagggtggggtccctcatcacacctcctgccttttttttttttttcttctctgagacagtgtctggttctggctctgtcacctaggctgaagtgcagtggcacaatctctgctcactgcaaccttggcctcccgggttcaagccaaccctcctacctcagcctcccgagtagctagctgggactacaggtatgcgtcaccatgcccagctaattcttgcatttatttgtggagactggctttcgtcatgttgcccaggctggtcttgaattcctgagctcaagcaacccgcctgcctcagcttcccaaaatgctggcattataggtttgagccactgtgcctggccctcctgccttgttcttagctgtctttctcaaacgagggcacaaacaacaataactactgggagaactttgtcaaagcatccattctcccacccctagatccaaccctctttgaaatctccaaccttacctccttctcctcctctcttggtgccttcctggaatgtttcccaggtgctggactccacggcacaacaagtgaagcactgagggtactgacttaaagaggcattcaccctctcccaagtcctaagcactgactccttgaattgtgggccctgggtgcctctcgctagtcttggccctgctagggctttccgtcgattcatcatttgctgcacggatgacaaccatttcttttctcccagtaggttagataaagcttagattaattaacagtagagcttaggcaacttttcttgctggagtacttacaaaaaaataaggggttcctgagagccacccagactgatgaaagatcagcctagctgcactttagactcacctgaagtctagacgctcagcttccagggattctggttccattaggctggggtagggcaacatgggtaattttaaaaagcttctcaggtgatttgtaagatgattagggtccaatcactggcccgggctcagggaatctgtattcaagctcccagatgattcctacatgcattaaagcttcaaaacccactggcttcctattaaactctccagctctgaaatcagacccaggttcaaatcctcatgtttttttgttttttttttttgaaatggagtcttggctctgtcgcccaggctggagtgcagtggcacaatctcggctcagtgcaagctccgcctcccgggttcacacaattgtcctgcctcagcttcccgaatagctgggactacaggcgcctgccaccacacccggctaattttttgtattttttagtagagagggggtttcaccgtgttagccaggatggtctcaatctcctgacctcgtgatctgcccgccctggcctcccaaagtgcgtgagccaccacacctggcctcaaatccttattcttgcactcactaccatattactttgagcaaggttcttacccgcttcttcacctacaaaatgacaataataacagtaccttccacagaagtgttcatggggattaagtaagatggaaataagttagcatactgtatgacatacagcaagtcccactaagtgataccttattaacatgctaaagcatttattgagcccttccttattgtggattagcattttatgtgtgtgtgtatatgagacatagtgactcatctccaggcctgtgactttgggctacttaacacctttgtgcatcaggagattataaacagcataaaagaagtaagtcatgaggattcaatgaaatattgcatgaaaagtgtttagtagagccctagtacatagtaaatgctcagtaaatgccagctgttataattgcacataatagtcaattttcaataaaagttgataattctggagtattcttaatacatttcctgtccaagaaaatacccagcttggctcctaagtaaagccaaagatctttcttgtgcttatttcttagattttgctataggggctggcccgcatcacgggtttaaggaaagttttctaaatgcacaaacgaatggattactagggaatttccacttgccttcaccctccacactgattttgcctgtgactcaagatcgtgaaagtcttcctgaccacggggccattcattccgtttccaaatgctgcaacccgcccatggctctaatcaagagcagaactgatttatgctggaagtggagtgagccagggaggtggaatcctccaccgctgatttgtttattgctgagtccttgaaaattgaatagggaggaaaagggaggtgtgagaaatgagttaagagctactccccatcacatttgataagaggttctttcactctggaagagtatagcttttcgttgttgttaatatgaaaatgctataagtgctacaaaaacacatgtcaagttccatgcctgtcttccacctgatggccaccaagagccctgacaatgatggaatagcaagctgcctggatttctagggcttaattaaggaactgtaacaggctatgctacaactctgtaatactccttggtaaatgactacagtagataaagaaaaattggtttcctccatttagcagatattgattacagggtttgttttaaaacatttagactaacttggttctttgttttatttattcacttccatgcattaattgaaagcccacggctcagattgtattaacttgatcgccctctactggccacatgctggagtacatgcctgtttttgacctatcctacaaaaactacagctatttttagaaagtattggccttttcaagtcaaacatactttttcaaggtcaattatgagtacggtggggagactcctgtatataaaaccccaaattgtctactctgtttttgaatattctgcttcctgaaagatctttcgattccatatatttgataatttaagaagaaccatgaccaggagccagaagatctgagttcacatgggcctaccctctcatctatgaaaggagaaggttgaggtaggacaggcacaaggcccctttttaatctctcaagctggggcggtagggactgcaccccatgttagaagccaggtgccctgcgatcgagtcctaatttgagatttagttctgattcccttttactcttgctataaagtgaataaggagggtatgaaatctccagggttcctttgaattccaatatgttaggactcaattcatactaacctcgagcacatataagtgacagggaggaattttcggaaagataattcctcttaaaacccctttaaaaggttattttttcttttttcctatgacaattttctagaaaacataggatttattcctcacaaagctccccatacttgtagctgaaactattgtctccacatgaacagtttgaataaactgtaacatttttattatctagaacataggagagaaaaaaatccaacaccagattctagatggagatttattgcagattcttataatttgggggggaaaataaaatgatgaggcccttcaagtccaagggagaaaagctggctctgagtccctaagcagaaacattttttaaaagctgctctacttccctccacaaagcagatctgcaatgtgatcggcaaccttttgcttccatcattttggtggattacccagtccctagacacagttcaaagaagacatttgctcaggtagggtgagcacagtgtaatcctccatccttgcaacaaacattaagagcatttaagaaagtcagagcaaggcaatgctggaagaacttcttttctactatgagaaaaagcagaaaatgccacatacaacaatgtaaaattgattgacttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttttatatatatatatatatatatatatatatataatatgtatatgatggaatactacccagccataaaaggaatgaattaacagcacttgcaataacctggatgagactggagactattactctaagtgaagtaactcaggaatcaaaaaccaaacattgtatgtcctcactgatatgtgggaaataagctgtgaggatgcaaagacataagaatgatgccatgggccaggcgcagtggctcacgcctgtaatcccagcacttcggaaggccaaggcaggcgaatcacgaggtcaggagttcgagaccagcctgaccaacatgctgaaaccccgtctctactaaaaatacaaaaaaaattagctgggcgtggtggtgtgtgcctgtaatcccagttacttaggatgctgaggcaggagaatcgcttgaacctgggaggtggaggttgcagtgagcaaagattgagccattgcactccagcctgggtgacagggggagactccgtctcaaaaaaaaaaaaaaaaaaaaaaaaaaaaagaatgatgcaatgagatttgaggacttcgggggaagagtgggagggcgcaagggataaaagataacaaatatggtgcagtgtatactgctcagtgatgggttcaccaaaatctcacaaatcaccactaaagaacttacccatgtaatcaaacaccaactgtaccccaacaagttatggagaaataaaataaaatactgaagtacaaactttttttaaaaaaaagtgaaaaacacaggatctgtatattaaattacaaattgctgatgaaagaaatcaaagagacctcaataaatggagacatccctactaggttcatggattggaggactcaacataataaagccatcaattctccccaaattaatctgtaagtttattacaacagcaacaaaaccaatactaggaagggagtcataggggcattacactcatgttgtagatgataattaagaagattatgtatcttccctacaaagaccaaatcccacagataatagtactattttctgatatttaaaattttgctctaagagattttcggagaaaacattcaagtccttctaaggatgctagggctgtatggatgcatacatgtgtatcttcttttccgaagggacaaaaaacaaaataaaccacatatttccaggggaaaaccaaagcaatagagtagagagaagaaatgtttgagtttgattctgcactaacttttccaaagcaagagttctattcagtgtgagtaccttccagaacaaggcactgtgtgggaaacatcgtagaaggctgtaatctttccccagatcatttcctggttggggaataaactattgcagattaatgcagattacattgtgttctctctgaggactgtagacaaaatagtggctattagtttctagggactggaaattaatagagagggagtttaatgcaagtcacattcaatcccatgagcaagtctttaaaatctatcaggtctagttcaaaaataggtctcacattccattattctctccatctccactattactatcttagatcagtggtccaaaagataggaacaggagcattgacagtgtgtttcatgactttcaggcagtcaatttcagagaaggcaatagcaaagaagaatcatgttcctttctgacttaaagaatttgagaccctgttcctattatctctggaatctagaggcatcacatcccatgcatcctctggcatcatgatcacagaagttttatctgcaacaggtgtatgaggagcttatataactgtgcatgctcataccctcctaatctcatccgcatgactattctgcaaacacaaagcataaaataccccagactagacaccggcatgagtccagctgaaaaaattgacagatcagcatggtctctgtataagcatgtgataaaatctctacagtcatgttttccaactgaatgctagctctccctcccctggatccccataacctttcttccattctctgataatagcttttcatttgctttctctgcctgttaaactgtaagttcctgtgggtagggagcaggtatgatcacgtgccttacttaactcagacagcaggataaaatgagtcctctggagtctcacagacctatcctggaaggccaactttactaactgtagggctttgggcccttaacctctctgagcctcaattccaataggaaaacagttattgtaagtatccaatgacatttatgcaaatggcttagccaatgcttgcccctagcaattgatgtgataaataataccactgtatcctaggttgggctctctagagttaatatttgagatggagatttgggtgtctgcgatttacctgaaggagaggtctcagaaagaaaggagttagggaagtaagacagagtcgggggaggagctaagctgaactctagcttcagcctgatcccacagggaggtctgaagcataaattgcaccaaaaggttggttccctcttgggatgggtccagccatttctatcctccccccattcaaaccctccatatccattggttactggctataggctgccttcctttgtgggcacagaaggacgtatcctccatggccaagcagctcccatggccaaggacagttccacgaagaatagggcagttgtgagctgacagtaacctatactcacagcaaccatgtaagggagatctgggaaaggcaccagaaacacccactacactattattatatttgtatcattctatgtccaaatatgagcttttgacatgacagggactcaataaatagttgaactaaattgaagaatctaaattgcatagactgtgcaaagccagcatgaatagcttttgtctcatccgcatattcaaaatctttggagacagctgtcacattcctccccttcactggccctcagaattgccaagactacacaaggttgtagcacacccctaaattcccaggcacactgattatgtatgacgctcacttaactgtaaattttcttgcttctcttgtttcagagattttctggtgctaattacacctacgcttacatccaaatatttcattgtgatgcagattatacttgtaagtgcatgaattattctttgaaggcaaaaggaattaataatgtttcaccattcactgtgacatgtttccaagcatgtaagtgacaggtgcacttttaaataatgtactttttcttctccttgacaagcaagaacccagatttaaagagatagaagatgtgaaggattgtcttgtggatctactgatgtcatgcttgggtttccatctccatcagcaaatgaacgaataagtaatgtatacaggtcccagtacctgctcagattagattgtatcagcagccttacactctgaaataccattaggacaaatccccaggcactcagggatagaaagagagagctgggttggtcatcagtaggaatggaggaaagctttttgtaaatcacaaggtgatttataaaggtcaattattagtattaattattctactatcaactttatgttcagtgctcctggctctacctacatctccttctgaattaatcagccccttccagagatttcacatctgttcaggtgactagggacaaataaaaaggagcctaaacaggttgaggaacctgctcttttcttgtacttttatctaatactctctctactggtagagactaaattgaattcagaaaacaaatctagcaggtggttctagagccttaattgtgagtggccaatagataacatataaaaggaaatggggattttatacatcatcatcaccctcatgaagtcaaggaaatgaatgcctaaagactagttgttgaatttcagaagattcatgtgtgtaaaacaagtggacctactgccccaattcaccagatttcattttagttctattaggatcatgaggtatttgagaaaagaagaaaaagaaaaaaaaaaaactcacaatttggtatgggcaatacaaaaagttctctctcacatgtattaatacatccactttaatggcaaaaacagactttaattttggaaaggaatatagctgagctctagattagaagcccataaactatggaccaaatctctcttctgcctgtctctgttagtaaagtttcattacaacacagccatgcccattcatttacatattgcctatgcttcttttaggataacaacagtggagctgaataggtgggaaaaagaccacgctggccacaatgccaaaaaatagttatatttggccctttatagaaaatgtttgctgactcttgctctacagccaaactccttgatattaaatactggttctatcacttattagctgtggtactttcagaaagtttctcaatgtaatcatcgtgaagaaatgaacactatctaccacttagggttgataggaagattgagtaagtttaaatatccaaagtgcctagaccagcatctagcatatattcaggattcaataactattagccattattattataaacagcaagaacaaatatccttctccccatacgcattgttggctctcatgccaaaagaaccacccagaggcccttctgccctttctcatggataagtttggaatgtctctccaatgttctgaatgcacatagatactttctaggtattctagttattctatagcagctgcgcagaagggaagccatttcttttcttttcctctctttattcttggaagatggcttcagttaaaaagctcaagcagagatttcaaacctccttcttctgtctaaaatatttaatggccagcctaacaaccctggcaaaacaactggtttgttttcacaactcacagtgttttttcatctttagaatcaattagaggttctaaagatattgtaggatcaaagattggcttagaatataaaccttgaattcctaagagagcttacaagtttgtccagattagatgctcaagatgaacagagggcccagcctctgtaaggtaggaatgtaaagtggggataaaattagtagaattttgaaaaacccacctttttgagaaatacagatgaataaatagattacacttctttctctctctctttcacttcctttccaccttttccttacggccaggttaataataaaaaggtcagtgttctgagttctaaaaaaaaatgtatactgatacccatatgcataaggcattgccctgggcaccatggagaaattcaatgtggtaaaattcccatcctagggagttaataatctgcttgagaaagcaagacaagcccatgaaaagttaaatagcaattaatgagttcaatgacagtacaagacaacagtggaaaagatactgctatgcaataagtaattagttgctaaattcagatagttaatattatagaaatttcaggggaaaataaaatccacatgatgtaaatttgttaaccaaaacacaagaaaatggccatcctacttcctcttactgaaggaagataaaaacactaaagttaaatatgtatttacatttcaagtgagtaatttgaggtgttttcatttaaaataaacattaattaactagcttcccaggctaacaatgtgtgttaatcagtcgctgaaccttgttttctaacaacttcagctgtaatgtgtaggttagaccaaaagattcagatggaaatcagaacaccaggaatggtgaagtcttagaagaaggcatgctcctgtagcaaaaacaggaggatgggatggggtcctgaacagcatcaaaaggcccacaagttgacagaacatagctgaatatcagagtagcctccccagagtcagtacgaatgaacaggcatggctgaattctaaaacattctagaaagattaagctaaaacatctacaagtgagtctcctgaatgaagcttctttatcatattcaccaattcactgcatccacccttatttcctagatgtttggggaagaggcttatatccagatatgccaccaaattcaaatttaactacaccctcagatttctgctccttttggaccactagagttcttattttggagcttgatgatctgcttgtataaactccgtaagcatagcagtaaagaatgtgactcccaaactaaactacctaggttccaatcccaatcccactgctgtgatctggagcaaattgcttatccatccactgagcctcagtttgcccagttgtaaatgggaaggatactagtattaaactcatacagttgtcattagggccaaatgtgctaatacatgtgaagctttttgaactatacatagtaaattccttataaatataagctggcataccctgtcactgctaagtaagagggcagaattagtaattcttttaattacttaacatgccagctatagaggcaacctgcctccttctctgggaccaacactggtcctacaaatggagctataacaagttggagtttatcaatttggtagtcttctttctggccttgtgtgtatcttaccccactccttccactaatacgacctaattataatattataattaattcaaaaattgtccttcttcctatcaggtcctggctccagactacctgtgtttctctggaaagagctattagtgttgaccaatgtcagtgattctaaaaactaagtcattgcatcccagccattctccatccactggggccccctaatgctatgctctgccactgatatatgcaggaggcagataaggaagggtccccagagaatttctgacctgccccacaagtgtttacaccagatgtttttgtgcagataagggaacctgcacagggtctttcctgggcatgcccacatgcactgaaggaatggagtggagccaccaggaattcacaccttatgcaggggaggagcctggcctcttcagctcctgtgtggtggcctggtattcaatctgcgaggtgggagcctattggcagggccccttctttctttgctgagagatttattttcgcctaatacaaccactttcctcacccttcaatgtgtctgtgtgcctaatttttcctggtcttgagacaagacctagattttagccaagctaaggagcaaaaaatcctgcatcattttggtggcccatatggggacctgaggaagggtgagtaaaatacggacctgaatgtttctttcccttttgttttggagccttcttgttctcagatttcttctaaaggtagaaaaaactgagacttgccttgtcactcttgggggtcaggaatgttggcctcagtccagcccagttttttctatggcaatttccttctttttattaggactgtaatggcagctatcttttcttttacatattggggggtgttccacccccaccccaatggccacaggtgcatgcacaggacagatgggtgagcagcagctccccgcccccctcccctctcggttggggctggggcacatggcccaagggccctgcgtggctggctggccagcattccctgccatgcaccgggagtcttcccctctcctggccaaggggtccacctcagtccaacagcaattaaaagtttctctcagctgggcacagtggctcacgcctgtaattccagcactttgggaggccgaggcaggcagatcacaaggtcaagagatcgagaccatcctggccaacatgatgaaactctgtctctactaaaaatacaaaaattatctgggtgtggtggtgcatgcctgtagtctcagctgcttgggaggctgagtcaggagaatcacttgaacctgggaggcggagattgcagtgagctgagattgggccactgcactccagcctggcaactcagcgagactctgtctcaaaaaaaaaaaaaaagtttctctccctgttggagaaacccatttacataagaataagaggttattcccccaggcatctttccagtcctgcacttaaactattattattttcttcttttttcaccctatcaggagttaacttttgtgtgagagatttttccttttagaaggtgtttttactaggccaggaccccaattcacaagatgctcttttctctcccttgttggaggggaacttggttccacagctttgccttaacattcagcttataaggagtccatgaaaccccatgagacacatttttgccccaaactccattccaagctttggaacttgaaggctactgacagcaggcgggacatggagttcatgggtaagagcagataatccctccctcaggcccccctattaacatgggtgaaagccacattgacactcatgggcagcaccctgtcatggccactgggattcgggaataaaaagatggaagaaggaaaaaggatgctttttccttctctcactcatatagcctgggtattcactaaaaagagaaagggaccaggggtgcctgttaccccttctagatgagtagccattcatctttagtctagttggcttggagttgagctcaggggaaaggaacccagaagcctgacatgctggcaaaagggtaaaagtttttaccagttgggcttttggcttccctctccctgtgcacaccagtaagaggaatgataagaatcactgtttatattatctgtgaagttctgattaatgaaaaaggatatatgaggttggtcttaagctgtagccaatctggtatgctttgcgtgtcttaattgaggtttgttggtcccactggtgaggttacttttgataaagttcaaaagctagatacatcagctgcttggcatggctaaagtgaactaataagggatttaaaaggattttcttaaagagagctcagcttaattagaagtgtatatccaagttataggtatatttaaaaggcctttatgtttttctcttcttgaatcttattttgctgaaaaaagggttttcctcagttgactgaattatttttctccattttgccttgccactcttaatgcatgcattagagcccctaagataatttctgatggcctgggactccttgggaaagacagaaaagacaccacggattccattttgggagaaacctctgttttcctcatggaagcccaggaattagaagcggataaatccctctcaaaatctgtttttgtcttccagctatacctgtttattgggccctggaaacagcatgctcttaaagggctccatcctgaggcaaataatccaattgggattgttgagattgggattttttttcttttttctccaccctgagaattgagattgacaaatgaaaaattttatagctactggatcttcttctgtctgtgtagttatatatgtgttgtgtgtgatgtctataaaaaagagctctaattaattggcttaaagaaaaataagcacttagatcaaacttagtcaaactttattgatgcctagcacataattaaaacaacttaccagattttacattacagttaaaaattcctaagagttaccactataacatgtaattgagaccactgaaaatggatttacatacaaggtgtgtaagaacagtaaaatgtgtttttagtaaaagattataagagggcatggaaatgtaaatttttgcctagggctaaagaattttttaaaattagataagataaagctaaaggtttaaacacattgtggaaggtttctaagaattaatcttgtaaaagaaattctgtgtttgcacattgacaaaattcaaaggggtattatatggttttaattcaaaagggtattatatggtttttctgcaaatggaacattgaagtaaaagcacaacaaggttttcttaaggcactaatctgctctttagcaaaatttgtagagggttataaaaggattataaggatctcacctggtggttaaactggttaagataagatagaattgtctgtaaagtttcattagaaaattgggatagacgttaatagtaagggtaaaattactattaatgtaagggtaaaatttggctttctctcccttgtacaagattttcacgtactagtaaaggataatgagcgattttcatttgccttgtggatagactgccaaggaaaagaaagagcagacaagagaaaaattttttggaaaacaaagtcttccctgttaatgagtaaagattttctgccttgttttaaaattcctaagtcatcgttttggcaaaataaataacttatggtaatctgaaattctattttatagcatcaagtgttttaaatttttaacatatttaacaggcttccctgaatcaaatttcagcttcaggttgtcttttctgacctcagcttttggatgctacagatggcccctggagcacccaaaagagaggtaaacaggattatttgacatgttgaggtacatgggattgccaaaatgatgtttaatcttcttcaggttataatttagggaataatattaatatatattccaaaattgtatgggatttctaaaattctaatgtttgggtatatgctatcaatcatgattaaggttgatattatgttaagttattgtaaaccacagagataaccaaatttctttgtcaatcgtgtttttgactgtaactaccctagaattttttttattcacaggcaattgttgtcttgttttgatcctgttcaaaagatggtttataatcagctatagaactttgacaggtactctcaaatgcagatttcttgtaattttggagattgtgacattggaataatgaattcatgaagagctgaaatgttcatgaatatcaaatagaacaagagttaatggaatggactgaactaatagaaaactgaagtagcctttttaaatgtttgcttagaacactgctgatccttgttttgtttttcagagtcaaggaaccttatgttcagctatttatggcctttaataattgaataaagtacaattctgtgacaaaatttggagcatatttgtttctctttgcctggtttctccagaatttggaaactagtcatgagtattcatgacttatggcagtattcatgacttatggcaaagtagttatttgtgtcagtgcaataagaatccattttcttttgcaacagaatgcaagtggagaaactggttgttttaccaaagctttgactggaagggtatgcatcccgttaaggaatcaagcttgacttgcagagctgataaaagtcccttgggaaaactggcctcacaccttgtattcacagtccctgtacagggttcctgacccatggtaagtaaagaatgttgctttctaacaagtccaggaatcacatgttcttggacctcaagaagagaggagtttatgcaactcaggtatttgagggtacaaactcatggctgggctcagctttaaaaaaaagaagaaaaagtcttatctcagattccttgtggaacagagttccatcaaagccaatctgaaaggcctatgtaaaaataattatttgtgctgtactttatgcaaataatcaggccaagtataagactaaagtctatttttcaaacaactcagtcccatcatgatttctttttgacaagaatgaggactggagagagataaattatgttccaaaacttagacatttgtcattaaattctagactcattagctgttttaattttttttcccccacattataagttaactctgattattcctgtgaaccaaccagtgatctccaactgcagctcagaagaaacaaaagagatgagtaatgtaaaaatctggatcaaatagtctagttctgggcaattaccttgcaaatcctggcaggtgataggagtaaatagggtgcccatcacccagaggtatcctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacatgttttccaataacccagtttgtctcttctggccttcaggccatcaaactccaaatactccaaatagtcctgccaccggagcctttgatgatcaccccttttaccagggacccttatataggcctatgagggagatctgattgctgattccccaaaacagcacccctgtcagcaggaagcagttaatattggtcttcatccttaaccttatccttatccttatccttatccttatccttatccttatccttatccttatccttatccttatctttaacctaagggcatttagatgtacttctaacctaagggcatttagatgtacttctttagtagggggaatgatagatgcaggaggcagataaggaagtgtccctggagaatctctgacctgccccacaagtgtttatgccagatgtctttgtgcagctgggggaacctgcacagggtcttgcctgggcatgcccacaagggactggtggcccatgtgcactgggtcaatggggtggagccaccaggaattcacgcctcatgcagggggagaaggctagcctcttcagctcatgtgtggtagcctggtattcgatctgtgaggtgggatcctgttggcaggacccactctttctttgctgagagcattcttttcacctgataaatctacctttctcacccttcaatgtgtctgcatatctaagttttccttgttgtgagacaaggacctggattttagctgaactaaggaggaaagaatcctgtatcattaccttctgagaacttgtttatggtaggactgctcaaatgatgactacatattaacctggataccttccactgttctgttgaaatcttcacccatcacttccctgcctccaagaatctgactggtttccatgtctttgccatatgtggtttggtgtctaatctacttaaatgctgtcagagttttccatatagcagatagcctcaaaaggctgaatcacctcctctcttgcagacgttatggcaaatacgctaagaaatccttccaagcactctcaaaggattcaccttctctgcctcatctctggttagttggtttgacaaaatgagaagacgagggtgacattcagaactccttgattctgctattattggcaaaactgtctcattagcattaaaatagggagaagacctaggttggaagggatattgcttaaaaaagaaaaaaaaagacttctgcttagcatgcaaactaaagcctaatacttagtatgtgctgcagaacagagttgctgaatagttctgccataaatcattctacaatgcttaggtatgtgaagctgtaaacccattccataattttcattagaaagagaccttcatttcaaaaaaaaagaattgcagcccctcagtagagatcctctggaaatcacataaaatggaaaaaaatgagggaatctctatctatctctaaacacacacacacacagatacacacacacacacacacacacaccagggcaaaatattaacttccaatcactgctagaaggcactaggtcaatcacagctcagaacacagtgaaaattgtgttacaaaagcaagcccgtctcccagacaatcctgcccctgctgcacacctgtgctgccttctcatccaatggcctccagaaacctgtaggcaagaagctgatcattaggagccttgacctactcactcgtccccaacctctggtgcatctctcagaatgtagcaattattatcctagcaccaacagcagcaaactaacatctcacccacaaatatacttcttactgcctttcatcgtgtagcaaatatccttttatgcacacctcaatcagaattacccaaacagccattaacacagcttggagagggagaagagtaagaaaaagttctaaaaccagacaaatcaactgcaaagtcaaatttgtattaagaacccacagatgctgggggctagttgatggaagttaggcaggtaaggcaaaatttaaggtgcattaaaaagctcagtgactgagatagataaattatattctaatgcaatacattttttaaaatagaagttaatacagataaattcattgtgaaccaaatatcaaaattttaaataataaaattcagcagtaccataatgagccattttaaagcctaagacaaaagagaaaatcagtgatgctgatcgtgttttcattaaatatttggatatttcattcatcatggattttttttgcatgaagtttgattttttaaaaatgttttattaaaatattacatatcttgatttaggagtttcctggtggcaccctcttaaatttgcacccaaggcaagctccttgcttatcccatgcttatccctgccctgctccaaattactgataattcttgtatcactagaaagaacaagtattgtcttctgatatagccttccataatattgctacccatcttatcttaaaaaatcagaggccccggaattagtacaagtggaatggagggcagatcctacttaagcattcttaaacagcttaaatacgcctcttgggttcaactgctatggcttttattcaagagaaactgtaattggaaagtcacaaatttaacattaacttttccatttctgctgtatgttgggtttagtttcacaaacaaggtccttttagatcagtaattcccaggctttataccatcaaagactctttttctccccacctgtaaccagggcttgtgttttgaaatactttttttttgccaaacatttatgaatgaatttatgcataaattctgtccaccatttaataggccaagatatctgaatttgccaatcatatattctgatcagtgggagatcacctatgattgccagagggaaccagcacaattgtgatcaaaggcggagatacttgacctgcaactcagcctgccaagcttcatcaaggatgccacaatttcattagatattttgaaatactgagttctcaaaaataattataatgaaatattaacttaaaagagtgacatgaaagaaatggtaggtataccatgttttcacctagctttataaaactgtaatgtaaaaaagtttggtatagtagtaacaggattacatatatatgtgtgtgtgtgtgtgtgtgtgtgtatgtgtgtatatatatggggtgtgtgtgtgtgtgtgtgtgtgtgacgttttcatttaaaagttgaaaaataatccagatctccattaccagctttctagttctttggggacctaaggacctcctatgtaggaaccattgttttgttgaaacaaatcagctatggcaaacaactgaaagagatctggtagagcaatgagtttctgagcaagtatgaatgaatacaaggcttataaatgtatggaaggaaagcagaccaagggacccaaagccattgatcgaagcctgacataattcattaagaaaataacatttccagaagtttttcaagattatctactagaatgtaagctctctgagttgcaggaaccacctgtgtggcctaatatcctgcagcgttctccctggacagactcaatgcatatttattgaataaataaatgaatgaggagttccttcttttatcaccattgttttaacatccgaataaactttaaaaggcatcaggattagaaaaccatattaagatagatatgggcatccaataggagcagacccttgggaccctgtttaaaaaaagcatcttgtcaagaacaatcattaagagacattataaagcacctcattcattcacacctgttggctaacaaatcaatgacatgttccacagatgcttcctcttggatttgtcccacttgaactctccaatatcttgttcaagatagtatacaaccttaaccacactcatttattcttcattttcactatggtgctccatcctgtatttcctgcctctccaacacactagtttaccctctctagtcctgcatttatcctctctccttcatcccatttcccacctacagaatttggtccagcatgggtaatttcttgcacactttttgagtgattcctcataacaattctatgaagaaggcaatgcaaaacttattattggtcccattctatggatggagaaattgaaggttagagatttaagagtgatgacctcagatttcagtaagtgatagatctgggattcagaaccaggtctcctttccccaggattctgttacattaccaaggacctcaacatggtatacagcatgcagttgctcaaagcctgacaaaatgaatgatataagtcatgtaagaaggttcagatgatactagagagctctatcttcctgtgcctatggaataaaaatataattctttagcatgatatataagatattcataatttggcttgtctgactttcctgcttttttctccatgactgctcattattcccacagtacccaaaccatgctaacctggcaggatcccttgtcctccaccttcatgcctctaagcctttgcctatgctgtttcatcctcaatgcctctcccaccttgttcacctagcaagttccaactcatccttctagaacctgttaagtatgacttaggaatctttctcactgaatgaggcttgctctcctctgtgcccacaacactgttacttcagcagcttccacagctctcaggataaggtccatatctttctacatggcagtcaaggcccttcatgatctagatcttgcttacatcttcagtgttttcttctcctatacctaccatgccctctgatgctattatctctccataatgaaatacttatggttttcacatacacatcactgtctgtctctcctcacagcttttgcacacacagctccctctgcctccctcatcacttttgctaggaaaatttcaacttggtgtttgtgaggtcttagctgacgtgtcacattcttctggaagcccgctgagtcagcgttggtgtcagtcttccttgctgcctgagtgcttccgccatcgtggtacctccttgctagtgtctcattgataagtacttagtgactgacttttccagtgctactgtagtgtgaaggatcccccatcaggttacttaagggtgtatatccactgcctgcatcttgacagccggctggttggtgagctgaggtcacggtgaccagccaaagagcaggtgtccctgagaacccaaacatcccagagtatctaagaacctatcaaggaaaacagtcccatcatgcatgcacagtaggcctaagagccagagaattagcttaaaagcagcttagaggtgggaagtggggcggatctctagaggtgccttcctgcctgccatccaggagtaccctatatgtaaatcttaactcatctgcttgccaagctgcacttgtccaaatcattcttcggtctcttgataccttcctagtttggggatgaaggtgtttttcccataacagttatccttatagttttttttcttctttaatatatttcctgcctttcccagaagagtctgtgatcagtttctcctttattttccttattgtagattcatttccatcttttcaggttccattcttcacagagtgcttccattgtttgggggtgactgatgtttgggggtgactgattgagggtgactgatgctattgtttgagggtgactgatgtggtggaaagaatgctggatggggtgctagctcaggctcaagtcctatccattcactcattcattcattctttcaacagctatttacagaatactttctacctaagtgctaggtactattctaggtgatgaagggaataagcaaagcccctgccctcaaaaggttttccagtaagggagttagaccagattaaaaaaagataatcacatatacaatgtaatatatactagtggtaagtgttatgtgaaaaaacattgctatgatattgctcatcctatcctggacaaacctgttaaagctctctgaaactaaatgttataaaataacattctaaaatggtgctaataatatctgctctaaataactagcaagggtggctatgaggctcacatatgaaagaatagaaatgcatttttgaaaacagatgaagtatatgcctttattgttattattttaattttgatgtaatgcagtgtctatttgccctttccaagagccaacacatgaattttaaaaaaatatccatcagtcatttagatgtttgaaaatgagcaaatgtctggctgacagcctcggtcttcatctgaatgtttggttaacctatctgcatggttggaaaagtcatgcgtttactgctgtgcccttgaaagcatcaatctctaggattattatttttttcttacactattgagataatggtaattttcctgtctaaatataaattttaaatgggcattttcatgcccactttgaaaaacaagctaagcaggactgtccatctcacataaatgttatttatatttctatgtagctcgtttttatttggggcatatgtgaattccaacaatgtgtaggagaatattaaatcattacccatgaaacttaggaatcaaatttaattttgcaactgtttgcaaaatttcaaaaaattgcagcatactttatgtagctttataaaggattaatacataaaaataaactaagcaatgccttttctatattacattttgctaaagaatgttttgatgtcaacttttttgaaagctgactagaagtgaggagagaatgtagcaaatagaggagagcactggcctctttacttatatatttgtatatttatttgcaattatacaataagatgtgaacacatgctcacaataattcagacagtaattaaaaggctcaagttccttttacctattctgttccctcatcataaccttaccccaaccatgaagtgattactgttatcaatttggtatgtatccttctagaatttttagtatgtaatcacaaacatatatatggattttacataaatagcacgctatacatattgtccagcaagtttgtttttgacatatgtcttggagactttaccatgtggggacatcgagttctagcatattctttttcactgtggcatagtattgtattacatggatccactacagtttacctaccccatttctggtgggtgggcttttgggctgtttctgatgtactatgctgtatatggttcccagcacacatgcatgcatatttctccagggtatacactgagaggtataattgtggcttcagaagtattcacttcctttcctccatttaaatttaaatagacactgcagacttgccctccaataatgaagtaacaatgtacacttccaccaacagaatccactccagttaagcatctctgtggtattctagggaggtagtcagttgggcagaagaggctggtgtcctctagctctctgagggttatgaacatacattcagtaggtaaatcccaagaggtgaaaggatctcagctggcaatggttctccccttttcatttcactagagtgaactcctttttaatgcttctttgtcctttcttatttcggtttttagctgaaataagatgtgacatgctcacaataattcagacagtacttaaaaggctagatctttgataacagatatcctgtgaacctgtgtttcacctgaccattaaaatcgttctttggaattaataacaactaccgttgattaactgacacacactttggatgtactatctcaatacatcctcaaaatacatcctcagaataactctgtaagataggtattgctttgatctacatttttcaaatgagtacacaaagaggtatgtaaatctacccagggacataagggctattaagacatagagcagaaatctgaatctgggctgggtggtttccaaccccagttctggggctatgagccactgggctctactgcaagcaatcattcccttctctgctctcctaagcctgtttatctctgcctcccttgcatcaggcattgctttctaccttttattagttatttgtcaataggatttatcttatcttttagcctgttagcttctcaactgaaaaatgcatggatgagtcacctctgtctccaagaccatttcaaaaaatacagtacctcaaacacagtaggaacttgataaatatatcttgaaagaaagatgtacttaccactcagcttcacaaaacttctcccttacaatccaagatcactgactgtccccctgctgaatctgacaatggccttcatgggtcgtccactgtggcatcttttcaggaggtaattctcatatcagaacttctagatacgaatggcttctaatcctatctctaccactgagaaccattttctttatggcccattctcacacgacaccactgatgcaggatctgatgtcttcatgtgagttaatttatctgatacgttaattagaattaatttgccttaattgatcaattggagacattcatatcttgcagcccttcacttctaaaccctgttttctaactttccctcccagacctcttcttctagcatttaaccccagattttagtcttttgggcatgcctttattctgctttccagctcagctgctgagggaaatcctgatttgactgcctggcttccatggcagctaaacatctggatactatcttttgaatcaccttccaattcatgctctaattcccatgggtgaatcacaccctacccatgactaaggcaaatcctcactatttcagttagacccagcatcttgagttcctgtttattcgaatggtaactgaaataacatataacaaacactgtaacaaggactatcagtgttctattgaaagaagtggccctcgtgtaaagaagactaagccaccactttctcctctacctctctgtagcctactcatcctgaaagccatagtccatgttgccttcctcaactgtccccaacagttattaggatacttattaacttctgatattcatcaaccaaactagcatttaattatatatggtcttatattgttttatgtgatctatcatctcccttattaagcaaaaagcttcttgtagcagggaacaaacatattgccatactctcctttatcatcattgtcctcttcaccattgcaaatattttctttaacttattgagtgcagaatgctttacatgaattaattcatttaatcttcacaagaacactatgaggtagatgccattgctatcctcgttatggatatgagaaaactgagcacagagaggataagtaacttgcttaagatcacatggatatactatgtggtgaatcaggtatttgaatcttggcagcctggttctagaatctaagagcttaaccagtgagactttctttcatgtgatccttttatagtaccaaaaacagctgagaacgtacatagtactaaatagtaataaataagtacaaagtaagtactcattagatgcctaatttacagtttgatgcccatgggcttttcagtgtccttgagtcctctctatcatcatctcaagactcaactgcatatagttcaactacttaacataggcctggacacagggaaggggtcagactggaacaagatttgttgacaattctgcacagaaaaggaaacagtcaacagaataaagacaacaccagtagaatggaagaaaatatatgcaaaccagatatttgataaggggttaatatccaaaatatacaagaaactcaatagtaataaaacaactcactttaaaaatagccaaaggacctgaatagacgtttttcaaaagaaagcatataaagagctaacaggtataagaaaaaatgctcaacatcactaatcattagtgaaatgaaataaaaatttaaaccacaatgagatatcaccttattcatgttagaatgtctcttaataaaaagatgaaagataacaagtgttggtgaggatatggagaaaagggatcccttgtgcactgttggtgagaatgcaaattaatacagccattaagaaaaaaagtatggtggttcctcaaaaaatttaaaatagtactaacatatgacccagcaatcccacttctaggtgtatatccagagtatatgggatcagaggttgaagagatatctacattctcatgtttactgcagcactgttcacagtagctaaaacatggaatccatctaaatgtccatcaattgatgaatgaataaagaaatgtggtatacacacaaatagaatactatccagccttaaaatagaaggaaactctgtcatttgcaacaccatgtataaacctagagaacactacattaattgaaataagtcagaaaaagacaaatatcgcattatctcacttatatgtggaacgtaataaagttgaactcatagaagcagagaatagaatggtggttactagcgactagatggtgcagggttggggagatggcggtcaaaggatatacatgtctttttttcttctttctttctttttttttgagatggggtcttgccctgttgcccaggctggagttcagtggcactatcatagttcactaaagcctcagactcttgggctcaagtgatccttccacctcagcctcctgagtagctgtgacaacaggcacacaccaccaaaggatataaatttcagttagacagcaggaatcagttcaagagatctattgtacaccatggtgactatagtgaataactatgtattgtatactcgaaaattgctaaaggagtagattctaagtgttttttaaaaataagaatgtgaggtaatacatatgtataattagcttgatttatctatcccacaatgtatacataaatcaaaacacaatattacatatgataaatatatactatatttatttttattttatttttttttagactataaacataaatattattgtttggcattaccccaaagttcccctttaaaaaaacaaataaatggaaataatatatatttgagtgttctgtctctactttctttgaaccaaggaggcctcatactttatgagtttgttccaccctcttctaatatatctgtcaacagagcatggcaacagtgttacaaaatttaatgttttaaaattttgaacaaattaaaaacatgaaatttatatttctcttacattttactattctctaatgagggaaaatgatttaaattttggactaaatgcaaccagcatataaaataattctcttctgagtgatagtgaaacaattactgaattacaactatatgcagaaagtatttttgcctaacatgttttccatgtgactaacattatagctcattgcaagtggtttatttgttttataattaataaagaagtccaggtggagtttaacacaaaaacagaagatagagagcatttaattttgtagagagctttcagtactaaaataggtagtcagaattttctgactttaatggagtcagaaactgggtaactttcattcttttaacttaaatcagtttctggatttagtttatcaaaatagactatattgtatgtgtattggtgaactagaaatagatcagctctcaagaaaatgtggcacatatacaccatgaaatactatgcagccataaaaaatgatgagttcatgtcctttgtagggatatggatgaaattggaaatcatcattctcagtaaactatagctaggacaaaaaaccaaacactgcatgttctcactcatagatgggaattgaaaaatgagaacacatggacacaggaaggggaacatcacattctggggactgttgtggggtgggggaaagggggagggatagcattaggagatatacctaatgctaaatgatgagttaatgggtacagcacaccagcatagcacatgtatacatagcacatgtatacatgtatacatagggcacattatgtacatgtaccctaaaacttaaagtataataataataaaaaaagaaatactatttttatttttaaattaaaaaaattaaaacagcttgtccccaagagctgtggaagcaatggagaggcagactcagaggaagacgctgcaagagagatggtttgactggagaggcactgagcatgacaacaacaggatatggtccagatgtggcagacagtaaagcacatggggggctaagaaaatggactttgaaagaggactgcctaaactggaatcccagtgccacagagtgctactcatggaactgttgtgagctatgtgagtcaattcttctaaagtactaagcacagtaaaggagaaaggtgtgctgtacctgttaactgctatattattctgaataattagaatgaagaccaatatctgacttctgggtttctgacttatatgtggggcacagcaacagggaatgaaggcacagtgaacatgcagaattcagcatctttcctcaggctctggccatctgagcacacttggttttagtgaagttagcttataggcagttctagaaacaaatttagggaggatttggggccctaagcctagagattccaaggtccttgtataggttaacacaatagaaatgcatgtaccaggtacagaagagagggccctcatcaggactggggtacaaactggggacttggtccagacacaggtgacatctcgtggctcaaccgaggcacaggaccacagtgagacaacagcaagggtaccttggagcagagcctaatatatggggtggaattacagggcttaaatcagtgctacctcttctcaggagtagcgcagaggaccatgggcaggctgagtatgcagataaggattatatgactccaaaggtaaggaaaagctgggagttgggctggacctaatccatgttgcatggagctgcttcactgccctgtctgggcctcaccttcttggtgagcaagcaatctggtaccatgccctttggtgaaatcaggcatggaacaggtgactgaccttggggaacgaaagccaagctgccattcatcacagcccatggtgcaaacctctaaggtaagccttggagcctccagcgccccagcggtggggcatccgtcctctgggcagggagcttcaattcacacagcaggagagccataacatagcaggagacacacagaaggcctttaaatgtctattttttaaagtggttagcaaagcaggagagaaactgtcagagatccgcaatgcagagtttaatctggaaagtcagtgaagaggtggaaggaaacagaaaacaggagactggaagaagaggcttcaggatttggggagagcaaagcaaaaagtgttaacaagaaaaaaaaaacagttgcatatcagaaactgctcaattctcatgtcaacatttacagaacactgttttccatttttccgactgctctatgcatttgacaaatttttacttgttcttaattctagctcaaagttcacctcctttagacaaagccataccctcttctggcctctgttttaatagatacaatgtttgtaatagcatatttcaaaatattgtgtaatgaattgtgactctggatattatagccactcatcattttcttgaggatatttatccttatatccccaggacttagtaaagttcctggcacatattagctaatggtcaattaatggtcacttaatgaatagaagattaatgaatgaagaaggaaccaaggagggaagatgctttatgactgtacagggtgcatgcgaggggaggcaggaagtgagatctataaaggtgtcttagcatatcatgctggtgatgtgagccaagctaagcattgcagctttcatccactggcaaggtagcataataaaaggctgtaaagcagaatgtttcaaagagctgttcccccagtgccatcttcactctatacgttattaatctcatttcttccctacttcgaactaatgtgctcacattcaaagatttggcatatatagacccattcaaaacaaaatgtttcaagttctccagaaaataatcctaaacctcaacttcttcaagaaataatcctaaaataacctcccatcagcttctttgttactcagtattttattcttaacttattgtaaccttgtacctatttatttgtcccttgggagatgatggttttctttaagagttatgagtgtactttctagtgccaaacttgggttcaaagcctagctcatccacccacaagctttctgtctttaactaaattatttaatatcactgagtctcagtctgttcacctctataggcatgataaataatgcctacccacatgatttcggtaagaattgaaggctattgtaaagtttaaacatgaactaaacaatcaataccagcagctagtaatagtggttctgccaatattagttaaaaataataataatagtaagtttgttcttatgccctggcatactctctgggagaaagaatcatcttctctttcttaggttattatttctttttctctcccctcctacaactgcacatctgcctcttcccttcacagtattttgcaattctctgtgtgactcaaagcagagctcaggttatgcatgacagctgcctcttccactgtgccctggcaccatggatgtcactgccatcctccaccccatgcatgagccagaaccctgggctccttctgactcaccattctccctcacccccaccatacacagttcatcaggctctgtgaatccacatcctgaacggctcctgatgctggccattgctctccatgtgtgccatcaccttcaacaggttacctgcatctccaacccagactgccaccagagcctcctgactgccctcctgaggtcgcctgtgagaaataaaaatggaatcctaagccccccaactgaatggaccctctattggccaaggggaccccagattaaccttaaaaattgagttctcagccatgacaggatgagaggtcagacatgcctcagtatatccctccctcgctaaccatgttaggctttcctccctaagggataaacagaaactagctctttggaaagactccacttttgataccaacaaaccacctgatgctgcccctcctttttttgcctgagaaaagaccactgaccatgcagtggttctggccagtctatggagaatgtgcagtaaaggcttttgtgtcctctgcttcaccttttgacatcagagagctcaaaactccacccttggatcatgctaatgctaccattttttttgtacatgggacccacaaatgggcatgaagttcaattgcacaggaccacgtttctcctttcatgaatattcatgactcctcctatagcttattaaatatgtatatttggccaccttgctcagcgcacgttcctattccctttacctctcccttgaagtgtctgtttctagcttctggcaagaggctatgcttcctagcctgtgggaatgggcaccctgcaggctgcaacactttatgagaaataaagctgttttcccaaatttatgaatcttgtcattcttcagttgatacttgtctccctctctgcttctcattactgctcaattctccactctgtagctggaggggtcttcttaaagcataactacgatcatgtgaaacccccaccctaaggccctctcctggcttccccattgctcttagcatacacatccaagttgttaaacatggctgtttaataatcatgcttattatctgtgctggagccacactgactttatatcaggtcccctctttgcataggctgctattgtttcctccaataagctctccaaataaataagccttgcataatactgcttaaaaccaaagttaagtcctgaactctgaactaggaaggtctctttttagttcaggatactgtatgtcactgatataaagcactgtgtggagacaagtctcagagaaaaagacgaggctggcagaatataagagaaagtgacggatggaggaactggatgcctaaaagcacttcatttcacttttctaaatgtgccctgtcaaaatgaagggagcagacccagtaaggctgaagttagtggttgcacaataaagtagaatatttatcttcgctctggagctgcagaccattagcattagaaaacaccaccaagtctgtctcctaacatgcctggggccctcggaatggggaggatcctgatttaatgagcaagttacaccatctgtcaacaggacggctgagaggtaattcagccaacagcagctcccagaatttaaggagcaaaacacttgtgtgctatttgtgtaagacatggcccctagcttcacggtcaaggaatcctacgcaccctaactactcaagctgggagtgaggggtggtatctgtgtgtcttgctcacagtccagccagcttcagcttttttgtgtgggtgcttgatgagctttgcagaagggagacatccagctagaaatagggtcctggagagttccctctgcccccctttctgagcctaataatttctggcaagaggctacaacacgtattaacataaacaatatcactggccaaagtattcacactgttatggatggaaggaaggaggtgacagaagagagtatatttcatgtatattccttgtgagacacgattttgaaatggaaataatctaagagaataaattttgcacctagattagtgaaagcaacatggagttgctttggaaaatacctcagttgtaaaataatgtgatcttttactaaatgaactggtaattaatatcaaaatgaggaattttttccctgtaaaaattagtcaacttggaaatctatataaattcttcttctgtatttctatagctcattttataatacttattaaattttgaagtttacggatgtggggattttttttttttcacacacacttgtgagtccctaggccagagcttggcacacagggaggtagggtggcaaaagtgtatggacccaaaagtcaaataacaggaaattcaaatcccagctctcttacctagcagtatgaatttggtcatatttcctaagcctcagcttcctcatctgcagaatggggagaacaactatccatttctccagggttgatgtgacaattaaatgaaataaataatataaaatattactattatctgtaacacacaggaatcactcaataaatattgactactgttagatattcaagtgaaaatattcatttcagcataatgcttttatgcataaattgttgtgaaatcatcttgacatcctaactcccattgttcaaaacaaacaatataaatttgggtaggatttgatatgaagagacaactgaaaatcagttaaatataagcctggtatctatgaacttcttgactgtcagctttgagtcttactctcttattctcctttgaagctataatatctttcacagtgcttggcactcagctccagaagctataatatctttcacagtgcttggcactcagctccagtaaatatttatttaataaatggaacatttgttgaataaatcacggggtgaataaagtgggtgaacaatctgaacaatcacaagcaattttacttagcttgtttacccaacctagctttaggaatctattagaatgctatcaaaaagtagagagcactggatgcgggaaatattaataatttttctagctttccttcaccacagctgtggtggacatttgtcatgctccctggactgtcatcacattctgaatacctatcctatgtgcatcagtttcccattgctgctgtaacaaattactacacatttagtagcttaaaacaacacaaatgtattatcttacagttctggagctcagaaatctgaaatgaatcttaaggggctaaaatcaaggtgtcagcaggcatgtgttctttcttgaggctccagggaagaattaatttccttgtcttttccagctactggggatcttttgcatttctggtaactcccttccttcctcttcaaagcacatcaatccaacctcagcttctgttctcacatcttctttttctgactctgatcattctgcccctcttttataatgacttttgtgattacatttggcccacccagataatctaggataatctcccaatctcaagatctttaatcatgaatgctaaatcccttttaccatgtaaaataaacatattcataggttcctggcattagaattaggacacaaacatctttgggaggctattcttcagccaactcactatatttggagtatttcctgccttttgtatccagtcccacccaggtagaaacctgtactttactttggacaggatgcaggcatgtgactgaacttagtcattcagatgcctgagattatggttctaaagtgaacagcatgagcaagcaggtttgatatcaaatccatcttctggtgaggttggtagcagcagtgtccagctttctggataccaatggtgtatagagctcagtccacaccagtgatgagatctggctgtttctacacagcagtggcaggagtctttttttagagcaatgccataatatacccttgtaagtacaatttccaattactattttttggcctaccctcagactctgtgagcacctcaagtgctttaataaaaaattttttctgcttatagtagtcctgaaggtttcattatttataactaaggaacccagtggacacagcctcctgtgctaggttgtaagaagcgcttgcagggaggctgacggagtgctcctagaaaattggaacagcagacaatcatttggggcaccatttaggtgccaagtacttagtaaaaaaggccctgaagaaatggaatgcaatcattcaaactaggagttggtaaattgcgctgttctttataatacccggtgtagggggaggagagaaagagaatatcctatggaggtctgttctgagactttgatcttcatctcttctcaatatgacagaccaattcagatagaattctgtttgtgaaggaacagcaagagagattttgattactgattctggtcagcatggatgcacccctcagtgattttcaaagcactttatggcctttagttgtttacattaaattaaatagtcttggatatccattagtttagaaagcaaaattatatctggcttaaaactgctttttgcctactgcctcattcgcctctgcattatctagaacttgctcacatatggctcttactttatccatctgtaagacaaggtgatttttttttttttttcgaaataatgcatttccatccctctctgttcggtgtcttttgcttgcagtttggagagcttggttcaaatcctaactctagcagttagtagctgggtgacttgaactagttacttaacctctctgagcttcctttttctacaaaatgttgataatatactcccaaacagacttgtagtgaagattgaataagtatgtgatatggtggctgagctcagactctggattcagacaggtccacattcaaatcttagcttacatcttaacagctgtgtgctcctcagtgttacctgggtgcctgtctcctctcaatagaatcagagatggataagaagtccctcatagggttagagataaaatgagataataaatggacagcactttgcacagtgcctgttaggttctaatattatgaacagttaagtggctgtttggagtgggtgtttggagtgaattaaggaattatcaaacgaaagaataaaatcaacttcatgttttcaaacacccccaccaccaccttctctcaacacggtctctagtgatctgaaatcctttctaaataattgtttaaaagttgttaccactaacagagatcagatctgtggttgcctgcacaaggattggagagggactgactacaaagaaacatacagaaatttggggagtgataaaaatgttccacatcttagttgcggtggtggttataggactgtcttttttaccccaaactcatcaaaccatataattaaaatgagtgcattttatgtttaatgtacttcaataaaagtttatattaattaatgtattatgcttctagagcaagggttagcaaacatttttctgggaagggacagatagaaagtaatttgagctttgccggccttaggctctgttgcagctactcaactttgcccctacggtgtaaatgtagccatcgaaaatagatactagacagtacataaatgaatgagtgtggttgttttcaatcaaacacaattcatgaaccaaaatttgttttcatataattttcatgtgtcatgaaatatattatttcctcttttgatttttttccccaactatctgaaaatgtaacaaccattcttagcccctgggccttacaaagacaaggcagtaggctggatttggtcagtgggccactgtttgtcagcccctgctctagagttccaaagaggctttgttacgcagcgttatgaaatctgctttagggacttagtgcaaataccatgtctaagaggactgggagtccagctcctgtgagccctgtagggtctttgccagaacccactctctctgtggccagcctaagccgctgcttcttgacttcaattttgccatctgtgcagagaggacaacaatcatctctcagagcctggtaaagctcattcagcttgttatttgagagaaaatgctctaccaagtgcagaagctgatcatggcctgggttatgagtctggcctgtctcaatcatcagggggaaagtttgatttctcaggttgtcattcctaaaattgcttgttctccaggtgatgttcttatttctgaatatggtctgaccttcattccccaaagagaagggttatgttttcaaagagctggcagaagaagagtactcagaaagcttgctccttccctgccgaactgccatcccagcacaaaccatgccttaggggagggtgactttcccccataatgtttacctggatgggaccagagctactctaagctcctctgagagcaaagggagctttataaatgcaaaccagcacaaactgaggtttcttgtttttggtttctgacagtagaaggtgcttgaagcattactttggggtagtaaaatggccaaggtatccacaaaagtcaagacagttctgaggttcttgaagcttccgagcttttaaaaattgactattacatgtaaaattcaatcaatcccttactgaagaaaaaatcattattcaggtacccagtttatcctcctacctgttggaagcatttgattcaactgtttctcagaaatgtttttttgtaaagaggcagagaatacatgttttaggctttgcaggcagtatggtctctgttgcaactactcaatgctgctgctgtgatgtaaaagaagccctagacaatacatcaatgaatgagcatgactgtgtcccagtacaactttgttttctaagttgtaaacaaacaggttgtgggctggatttagtccacaggctgttgtttgctgagctctggtctgagttgtgttatatctagaagggacttggtggtttagggaagagaaaaaaacctaaatcagcagagactactggtgagaatgtggaaaaacctatcattacggattggagagtaaaacccaaccaatgagcatgttgcattaggagtaggatggggataccctagatgaatcctggccatggtgaattttcctgatgaaagtagaaaggcagccagtggatgggcagcaccggggacaagaagagccgatggggcattatggggagatactgctgctggctggactgctcataacagtgttcacaaagaagcctctggttgaacatgtgagaacctatgagtaagccatgtaggattcaggtgggtcaaaataaggtaaaaaccacagcatgagcaaaagcacaggtaagtgtctgcaaggtgccttcacagaatcctgagttggaaattggagcaaagttggaaaggtcagtctatggcacatcatggaagactttaaaacatcactttcaacagtgtgaactcttcatttttaagagtcagtgacaggtactgaaggtttctgagcttgtagtaccatatcccctacaaagcagctaactcaaatagtcttcctcctttacaaagagactatggttggctgcatctcacatgttatgaatttgatgctaataccagatcacatttattaagccattattatgtgcctgataatactgtactaaatgctttactttcatatgtcatttaataatgcttataaaaaatcactgatggggttattttttttgaaaatacttggaaaatggtttaatgatgttttacaacagaaatgaactgtacagttatggtaagtttaatatatatataaaattacagcagacaaatgcatctacacaaaatctaccatttcattctgattcactgtcacctacacaatctttcccaagcctacaacccctgcaggcagccctaggagggggaatcatctaaagggcacattgagagagacagcaccgctcatattcctcacaacctcctcaggcctcaggagctgatggggttatttttatctccattttacagattagaaaactgagatccataagaagttaacttacccaaagccaaccagcttgtaagaggcagagtgtgggtttaaatgcagctcttaatcattctcaactcaagctatatggcatctcagtggatttaaacatatttctgcattttaatagttaaataaaatacttttaacatcatttctaaattgtttctccagtgttccctctcctcaaagatctccaatactataattacatttgtcatccttttatcttcctatgaattattttttaagatcaccagattaataataaaatatttgtaaatttaaattttgttcaaatttaatacaatcccagtgcactgctttagtattaaatcttgatttccatcaatgacatatctatccatctatgtatataattattttcacattatttgggctatattttaggaggatgttgctttaatgaacacaaaccatatatttatctgacatgaatttttggccacacacaataatgtgatataattttaaataagtaaaaaatgcttatataagtaaaagcttagaaagaaacaaaccagaatattaataatagttgtattatggttatgtgattataagtgatctgttttttctcttttttcccaattattttaaattggattatgttagtgttaaatttttaaaatataatcatgtgaaaaatgttctttttaaaaaaagagaggttataaaataatccagtgggaactaatcagcaactaatgaaataatgcccaaatgcaaaaagtgatgatgttccatgaaggttccatgtacttaaagctactggatctcattaaatcactgggacctaaaatcaggctggctggggtgggtctacactcagcttctctaagtacaatcaatttaagagaaacaggagtaggggtttagtggattagtcacagcaggccattaatctctgcattctcagttgtaatccagcctctaccaacgagcttggaggaaaaaaatcccacaaaaaaaccaaacactgggaaaagctctaaagcaggctccctagagacagacatactcaggtcacagtttgcttgtctttacttaacatcaatacagtatttatcatctgtcctatttcttgttggtttcccttttatgccttttgctgaaatgctcagatcagatatatttgaaaaggaaccatactgcaatctcaggaatagctcagcatttaattatcatttaaagaaatccttctctcaagtgaatatgaaacaaatcaaagctatgttttcatgttgagaataggttgaaaaaaacatgggtaaggttaccacaaacacaaattagtgcttggggaagcaggtaagtctgaacaatgaaaagggaatagagtagccaaatttcagtaaaaatgagtgacagtttcaaaaattgcagggtaaatagtgtatcttttatcataaatggattaggccataataatacctcacttctttattgctctggcaaatgatctagaatttactaatgtattaagtgggaaaaaataataagcaaattcctgagccagggttctatttatgccactactgtcaaggccgaatatttattggattatatgagaccatatgcctacattagaggttttgataaatttaaagtgcagttgtaaactaaaaatatggggcattaatttcttaatttttaaaaaattattaaaggaacatatgggcaagacccagtaaactgtctctgaagatgatgctatgaaaagacatgattatctcccttcttattacctttaaaatattccccaaacattctagtttcccctagtgaatcagattcaaccaaccttaactgattatgtgctatgtgcagacattgtgctgaacactttcacatgcattggctcatttaatccccatgttttacatgatattgccaaattccttcctaattttgctcaacgtgtcttttattcttttagcttcagccatatcgaaagcaaaagccaccatttatcaagtgcattctatatgccaaacaccaggctccattttttttatttcaagcccgcttaactccaaaaataggtgttattgcctccaatttacaaatgaggatactgacacttagttagagatattaaataacttcctaaagtcacacaataagaaacatcagagttgaggttaaatagtaagataaggtataacgtataatgttttcgatgaatgctcttcaatacatctgtagcagtcaatgacgacccctagactctttcccagcgttgcactagagggtgacaaggtaatcattccacaaatgttatttgggttatttttctcataatgccttatcatatgattgcccatatagaaagtcattttccactttttgttcactcacagtcgtgaaagatcttcctatattttcatcttgttgcctcaacatttcaaaaactggggaagtttagcatgaacagcaaatttggacaactttctgtaaaagtctcttaatatactaaagttcctaagttggaaagggatctagaaactacttagtccaatatgcttaaactgtttaaaaggagaaaactggccccagaatagtaaaattaattcctccatgccacagaagtagtagtggcaaaactaacactaaacacaacatgtcctaacttccatcctagtaatctcttgagcaaatcacctaattctatcttccctataatgtataaaaatgtgctccaagaacaatacttaagaaggcttaaaattctagacctagaaaaggtatttgtttatcttaaccacagtttcctgtctctgatctaacttgttatgcaaaataacatcttgaatcccatagctatttaggtttgtttaatagattttgaggtaaaccattgctgaaaggatgtttgaaagattagtcactattctacatacttgcttactctctcaaggaattcaagcacattactagagcctcataaacaggttatacattactttcagatataatacagtaaaatggtaaggaacttcatactgtttgacccaataatcacaatattgagattatttttaaaaaaaattcgataaatatctacttggataaaaacaaatgccaaaaaatgtcataaactagaaacaacatatatgcttaaaaacaagggaaagttaaatataaataatgctattttacatgaataaactactatggaaatataagaaaaaaataatgcatattgaagtagcagatactagctaattgttcgcaaaccattttccctttgctcctggctacaaggctagcctacaactctctaactgctttaaaataagatgttaacaggtgcaacacaccaacatggcacatgtatacatatgtaacaaacctgcatgttgtgcacatgtaccctagaacttaaagtatgataataaaaaaaaaataagatgtggctggctgggcactttggttcacgcctgtaatcccaccactttgggaggccaaggcaggaggatcacttgaggttgggagttttagaccagcctgaccaatgtggtgaaacaccatggtaaaaaaataaaaataggccgggcgcggtggctcacgcctgtaatcccagcactttgggaggctgaggcgggcggatcatgaggtcaggagatagagaccatcctggctaacacagtgaaaccccgcctctactaaaaatacaaaaaatcagccggccgtggtggcgggcgcctgtagtcccagctactcgggaggctgaggcaggagaatggcgtgaacccaggaggcggagcttgcagtgagccgagatcccaccgacagagcgagactccgtctcaaaataaataaataaataaataaataaatataaaaaaataaaaataaaaataagatgtggcaatgtgactgaccagaaaggatgcccacagcttttcttcttggcccacaaaaacccctcccatggtcttcctctacactttttttccccatctggtgatgttgatgcccaggaaaactttggaaaccataggaggtagcacagcccccatcaaccttgtgactcccaagtcaccactaaatacagaattttttttcttttatctctttcctctcaccaagcacctacatgcccacacacatacattgacatctattggacaattaatgcaaagaagtaagcctccattgtgttatgtcactgagattgtggggtgtatgtgtcagggtccaggatatgctgaactgacacaactaggaagcaacatggagaaatatttaagatataaagtttctttttacagtacaaattggaaaagttacagtttcaaaatttagtaaacaaaaatttggtctatggggaataatttttttcctaatttttttcataatattttatcatatttggcataaaatacactctgattccaggcttcactcatgtctgtgacactaaaacactttgcatatacagtccctgtcttgcaaggagcactgatcaagaaagaacatctgagttggatacgtaattggcctaaacaaccaaggcataaacacaactctcattcatgaagttgttcaacttgtctttggatgtggcacattatatgcctttacctggcttagtcaagctctaatttaagcagttctaaaagcagatttaaaaaaaaaaaaaaagcctgcactaacttatacacttaaaattgcatgtggctctcattcaaccaataaaactcagtgctaaaacaaactaaaaggccacaaggaacttcaccacagtagaaaaacaggaatgaaacttgttacagaaataaaacataatgacttcactactttatattccactctacaggggtttgagtcactgtaacttaagagccagtatcattatggtgcattacaagacttagacatcaagtgacatatttctatcacacccaggtcatacaatagaaacttgatactcaccgatgtctcactttaaaatccccaaacatccactgagaaattaacaatagggccccttttttttctataacccctttttatttttttctgtaattaagattacaagcaaacaacaacaaattatccaattgaccatctcctcacagttgtaaagattaaccaggtgattacagggtgaattcacagccaaggacagcaaatccactctgttctttcaattcctaggctgccagctcttctctggtaagaactagtcagctacaccacaattctgttacaaaaggccagaggggaagtaatgttttctgacacaagactgaaaacaccatagagaccacagtaatttcctgtattgctctgcatcaagactaaaaagtggggtaggctattctccctaaagcactctagttcaacacactaacaagggaacagtgagctttctaaagtgttgttttctcccaagtaggaacttggtaagaaatagcgtacatgttccaaacaatctcctcaagtaggaacagagatgacatggagaaaagaatgacaatgtatccactgatctttaattgtcctagttcaagcctttggtatggtgtcataaatacaaaagggccgaaatacattttaaacaactataagtgccccaaataaggatgatttgtcaaatggaaatatgagtcagagcaggactagaaaactatcaaacatattgctcattgggaaggttcccattctctgtgactctgcacactcaaaaacctacatgcagtagaagcaagacaacagctggtagaggtgtcttcttcatctcccctccctcatggcctcagatcttgtccctcagtctgccctgaatgcagaaaagccactctccatcgctccttattattcatttatgtattaattcagtcattcattattgagcattttctaaatgccaggcactgggttgggtaatgggaaaaaaaacactcacacatttgtgtgtcactacacacattttatagggcaaagaccattgctgttttttttactacattttatcttatgcctggcccagtgcccacctcataggaggcatttgttagcatttgtgcaataaattaacaaatacatttaacactgggaaaaaaatcttccatatatattactttattgtttatttcaagaatcctctgaggtatttattattattctaaccttgtgttggaggacaggcctatgctccctcaataattgcagctatcagaattgttttccttgaggctaaaaggtagctgtgtgtgtagtgagagagaggggagcggaaagagaatatgttgactcacatccttcagtaaatctgtttattccaactctggcattgctgccaaatgtgttgcaaagccagcaagacttggctctggaaaactcacctgaaagtcacaggcctcatttcctactgccagccccttcagccaccaggcatgaagtattggacaaagttaaagattaattcttcatttactgtgacaaaattaccacttctcccagatcagtaggcaaaggcatttgtatgctgtgtccttcataacctttgataatctctccactgccatcctgatggcccagtaatgcaaatgtaatcaaaccccacactggctatcccgttaccagcccaatcttgctaataaacagcaattgtggctttgttataaaagtgatcctagatcatttgtcaccacccaaaccttcccaccccaacccctgactgctggaaatcctttaaaggtctgtttaaggttacatgaaataaaaactgcaaaaaagttacagaaaaccttcactaatcaatgagtaagatgataatagatataccgtaaaatccatggtcaacagggtcctggcttttttttcctagggtgtaaatatgtgacaataaactaagtaacaagatgatataaactctgtaatctatatctgggttattccaaagcttctgggaagccatctggaaccagggacaacagtggaaaatgatcagtggtctgggccaagtagagcatagctgaacaagagccaaagctttaatactgactggtctcttcctaatgaaggatgcaaactgcatacttccttgggcctttaaaagatgcctttcatgcacagagggaaaatgggtgatttttactgacattattatatgcaagggattactgttattgaaattatataccttaaatactcttccatctcaacctcatccatcacactacactctttagttgtgactatgttcactttttgaccgtctcctgaattaatcatgtcctatgtctcatctaatctcccttcctttgcaaatgctgtttcatatgatcatccatctctcatcacaaccctcttggttaagtagccaaaatcttccacgacaactctttaacatccttggagactcaccctaagcatcctctattaacgctacttactctccttctctacccctcctactttcaggatgagtcagatgtcccttctctcttctcctcaaacactttctatacctttttattacaatgcctatcacattctgctgtgactaccaatattttaaaaatcagtcttttactagatgaagaatttttggaggaaaaggtcactgtcttacttattctggttggattctgagtacctgatgtataatgtatcctcaataaatgttgaatgattaagtggacaatgaaaaccatttcatttaggtctctacactcattttatagtaactgaaccatagagtgggtaaaatggatatatcatttagttaaccatgggtatattctgttaagtgaatgtgtactctattggaaataagagttgaacagaatgtagtaagataaaactgctacacaatgctttgtagtactttgagcatctgttttatgtcaaatagtgtatctattgcttaacccataattaatcttcatgacaccaatgcatgtacagatgattcatttctcttagccttcatctaatgctaaagacattgttattattattcaagtacaaaattgaagatatttgtatttgcttaacctgaaaataccaaatctcaaagatcaggataaatgagggtcacgagagatttataaaaaatgaatttttaaaaaagtgtatcacttagaatgtcccataatgggcaaattgatctattaggtcaggattttttttaatgtgttttgtgatcaagaataaatgttgacagaaaaagaagacaaggagttgggtttctaagtaatttcttattacaatcaaagtaaaaatattaagttgcacacaaacctgattacgtcattttccttagctccccattagctagctcctcataaataaaaggtaaggtctaatcttattgtggtttacaatccccttcacactggcctaaggttatttttgtaacccctatatccagtcgtttagtctaacctatccactccatatgcccaatccaccatactttgatattttgttttttaaatatcttcttgtctatgaacatactattcttgccacatgatatgtcttctttctccctgttcttttgaaatctcatgtgttcttctaggtctaggtcaaatgttttctataaacattttcccttctccacttgtatctacaaacgacagagttaattgctcttcctttatacttccagtatactttatacacatttctattttacaacatgtactctcttgttaaatactaaggaccaaatattgttcatttctgtgattccagtgcctggcatagagtttgctgtcgatacgtctttgttgaacatagaataaatgattaaataattaattggcatttacaaaaactgatccaaagtgtcaacaagtattgttattgatgtcagtgatgatgatgatgataattttatgggagcaacttcaatttactgaatgattaatacatgtcaggcagtatggcagattcttatgtacattttctatacctcacattttacagatgaggagttaaggcacacagaacttaaattacttatccaagaccaaacagagagtgaatcccaaagttagaattcacacgtctgcctatctgggctccaaaacccaggcttactctcatatgatgtgtatgcattggccaatggctactgtattccagataccacattagccattttacaaatggtgtttttttatccttataattaccttgtagaaacaacaaccttgagaggtaattatcatctctgttttacagatgagcaagctgagaccctacctccagccccctccagttcaccccctacgaaaaaattccaactcaactgtctacaatctcaaacaggctacaaactatataaagtacagtgctagttgtagacatgcaacagaaatttaaaatccaaagaaatgttagaatttcaaacaaattttaacaaagaatccattgaaccgttgcaaagatccttaatacaaaaacgaaagtcacaaagtgaataaccatattaggacacttcatattctctcaattcaatagctccctaagtgggctcatcccaactttccagtatctcccaaagtgaattttttgtttcagttgggacattctttagcgtacatcctcttgtttctattcctcctttttgatgatgaggtcccctctgtctctttcatccaaacctccaaaatcaatctaatatactccttttctttcatgtctaaacttctcccttctatacaatttatgccaattattaaacaattagacattattcctattcctttatatcacaatgcattttagcattacaactttgcatttataataatatcttaacaaataaacattactcatattactttatatcattctaaactatgtgtatgtatctcaactttgcttctataactatatcttaagtatggatcatatatagtaatgacacagatgctttacacttgcataatgcaaaaaatatttattcaagaatcactctctgaagtttccctcagcaatgctttgaaataggcaaagcaaatataatttttattttacagatgaggattgagattctgagaggtaaagaaaactgcccaaatttataaaggtaatgaaggtagagtcacgttgaaggataggtcttctgatttccatactctttctataatggcttgctatcatacacatttatgatacctagatctctttttgaccttagtcccaagtatgtaatgcttaattaaggtgataaactgagacattagttactgacttaggctagtaatcaaacccctctccccagccaagggactgggtattcacatcaacatttattttttcccttgggatttcatacaactccaaaagactttcttgactcactatctggagagttttatctatgatgatggttatctgtcagtaactgggctatatgacatcacatgggaaactggatttaaagaaaccacattgctaatgagatcatcagataaatagtcattgtaagggtggggctttttatttgatgggacattctatttcaagccatattgaaagcatatgtcgtttgccagtgttgaggcactttaaagttgggtctatactgcattgtaatatacaactgaaagaaaaattcgctgatcccctgggtaataagtactacatggtttccaggtagtttagtaaactttccaagcctcaactccatattggactcatagggataaagtgggttacagttatgactatgcaccaaagcttaatgctaccagtctcatttgtatgagaaggaaaattaagagacttttcaaaattatttagccaaggcttcctggaaaatagggtttgtgctcaatgttatagatgtgcttgctgatgatggttttctttttgcttttaaacaagttgatatggaaaaaggtaaaagctctactccaccatgaaccaagcctatacaatgtcagatttgtaggaaataatgacattattgcatgcttactatgtggtagaaactgtgctgtgtgaaaatcattggacataatatctcatttagttgatagaacaaacatgtgacacgtgtactgttatctcttttctacacataaggaaactgaagttatgccattttaatgttaagattaggaaaacagtgtaggaaatattccttgcttgtagagattgctgatcctaagatgctagaggcatttgggtaatagcctcatctgtttgattgacagggtaatgtacaactcaaatgctaccttaattctagctctaaattgtaatcatctaaaacttttacttccaaattctctaagacttcaattcatttaacctaatttattctttcagagacatcaaaataaaaaatattaaataaaaatatttgaaaggaatcttgaaccaaaacataaatgatatactgaattttgactcaggtagacctggatgtgaaacctctagtctgaagctctgtgggctttggttgctatatctataagattatcccacaaattctaagaatagatgaattaaatatgtgcaatatatgtacaatgtgtgaaaataccacataattcaaatggttattgatgttattattatgaataaactgacaaagaagtaaagttacataaggaggaagtaggatgcattgtaaaaattaaatcaggcagctctcgtttgaccaagaaatttctctcctcgtgctgctaagcatacattcttgctgatctgagctgctttggtaggaagggaatggtgctcttgcagtacacggaaaaatcattctggttctctctctctccctctctctttctgtctctgatctcttcacagaccctggatgccttacattttcagaaaagtgagatctgagtttaacggaaagccagaggaactcccaaatcatgccctttagcctagctatgttgcattaagtagccaaagctgatgtgatctcacaaataaaagacatacatgctactgacccagcatctagctaagcctggccaaacagtctcattttccaacagtttcatcaaaaccaaattattagtgcagaaccaccaaatatgccaagcccaggtgtctgtactttaagcaatatatccaaataggcccaaggagaaatttgggggtgggttagaggaagtgttggaacctttggttaacaaaacactaagctacaaagcgccaatgttttcctgaaagcaaatgccaccaaatgaaattcagtcaatatatcttccacatgacaaagctactaccaacattttccttctgtaaagtgtttagactacagacttttactagccttttccagcctggtgtttctcaataatgaagccaactctatcaatgcttcaagtatcaatgtctggtaactctgtaaggattagcacccacttagtggtcaggaaaattcattccaagatgctaaagaggtgctttgtttttaatatttttaatttaagatttagtagattctatgatcacagggttatgttcctttcaatagagctcagtcatgagtaaattaaaactgcaaatcatggagacagaaatgaaagatccactaaactctctcaaagccacaaatattcaaccttagtgcattgcatttcctatacatcctaaggctgccagatggaaaaagaatggagtctgagtctcccaaactgtagcaattgtgagtcataatcatattactaataataattctcacatacatgggcattactgaatgagtggctctgcttacaggaggatgaggccaccctgaccatggagaagaaatggccttttaaagtttatggatgtgtaaaataaagagtatatgatgttgcatccctgcctaaatgtcttcataaagtgcaaattaatgcagatcctaactaggcatttggaacgctaacctagttttctgtgtttagctaatagctagcaattttgcttacacttttatcctctcattacatagcaataatgattatttagtaaatacatatgaaaggccatgtactccatagcactcctcctgagttggaaatccccctcctaatgcttccatttgaataatttagttgctgatacaccaaatcaaatatagctgtgacaggtatcccactaatgctttttttggaggctaagatcagaccctttctcagcctgttcccctcggtgattgcctggcgaaattcagggtaagggctggggacagagaggatgctggaggaaatccagagccttaatcaatgttaaccctttataaatcttaaaggtactcagatggcttgtctgatttgaaaattattaatgacactggggagaagtaaggaaaggctattttataactagtcaaatattctggaacaagagagagagtttgaaatagacatgtagaagagaaagatgtaaaatatggccttgtgagatgccacccacttcatatctggacatatgactgatataaacctttacaagtcacttgagaattttcactcctagatgcagaatggaataatagaagtcccactagaggagttggggtgaccccagggcacattttcttgtctgccaggtacacaacacatctcactgatgtatcacagagacaaatttcttaatagggtagccaagccccacacagaatgatttcggataagagtcccattccttccctatgaggagaaaattggaagccagactgggatttggaacagagtccagggtgagggcagaactagggttgttttctcctatccagaatcaggtctggcttaaagggaggggattgacagggctgaaggaagaggcaggaaacatgtctctccaccccagtgctgcttaaatgtggctgctcaaaggggcaatatcctgctctcctcttctgatgacttcatgggaagttggccgagtccccacttctgcagaagaatgcaggcagaagggagcactacaaatgggcttttccttgggtgcttaagtggcaggtgtgaagggaaatggggtgggtgccttcaatgggaggagccactgaactggggaatactgctggtccaggggctttcccctttccctcccagcttcctcccaaccccaattccctgcatcaacaaagacagtgctcaaaaaccagaactcgtcctaacacactcaggcacaggtgtccacaagcccaacctctttcacctcaacaccctgaaatcccgtttgctcttaaaagcacagacaggcccaagtagactgagaggtctgagccagcacatccttgctactgggaattaaaaaacaccgtgatgtaaagaaagtggtatttgtgacactgtagtgctttaacaagaaaattgggggggtagaggagggtgtgtcagcaggtttcaaagcatcacaatcagtcctgatgtgtttgggtaaggcatggaggacatatctctgatccctgctggtactctccagtcccgcatcctcccgcagtctcttgaaagtggttagatacccgggcagggccccgcgtccattttgccagccaggaaccaccgagtctgggaactttgaaagccaggggatgggggtggttgttgccaaggctcggatttcggcgccagagttctcagccaggaaagcagttgaaaatcaacacccatctgcctcttctttctcatcccccaccactttttccttcacccttctaggactgcacacagatcctaaccacccccccccgcaaaacacacacattcacacacccttgggctgagaagatttttgattctgaaggcggcaaacccgcagaactcaaagggtctcgccacccctctctctgccccgcggctatatacaataaaaccccatacaccccagacatcacaacataatccaaatcagccagtgacttcggcgcgtcccgtacctgatatgcagacgatgaaattggcttgaagaagaaaaagcacctcccagactatttccatcctctgattctcattccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatgtgcgccccagatgtgctgacacatgtccgatgcctcgctgccttggaggtctccccgctcgcgtgtctcttctcttcgcaccagcggcggaaaccgcactagcagcggcggcggcggcggcggcggcagcagccacctgaagccaccaacactgggctcttccagcaaaaacgagaccccgattcgtctggcgccccaagaagacatagacgatagccccccgccgggctgcgccgtgcaattccgggctcccgggagcgcgtagctcgctggctaagcccaggcagtccgcggcaagttgccctcgaagtccgcccccctcaccggggcatggtcggagggtggctgctgcgctccggggcagttcttctcctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggcaggactcatcctgggagtgctgtgctgtgctctccctccgctgcgaaatattggagatttttttgcataattcattccctgccctctccatttcgtccctctcatgccccccaccctttacccctttccgtgccagtgccagaacactacttaccccagagttcttttctctgcaggttcctagaccaggtgcaactcttgcctgcaagtccctgcctccctcctcccgaaaagggggaacaccgcctttccaagtccgggtgccagcagcggctgctgccaactgcgccttcgcccaactccaggaggatccgggactattggaaacccgggctttagaggaacgggcttcccttcttgtctttcttttattctgcttttctttagggaagctctagtgctttggaggcttttgctgggctccaggatactttccgccaacgacactcagcagcttccactgaaggagatttccccaccaaacccgcgcgcgcacacacacacacacccagcgcgcggctctccagggccccaggggaaagtaggggcggcgcgagcaccacccacccacccaggccgaggccaggggcagccagtccgcagaaggtctcgtggggaggcgggctgtctataacctaggaaagacttgcacccggttgcagtgtggatgcaggggaattgaagaaaaccctgtgctcagaactgcttgcctaagagggctgggaacgaaaggggaaagacaaaatctcaacagatttgtctgcttccatcgctgcagtggtggtttgcgaaagctcaaacctacctctttggggttattgaagaagaggagggagcgtagagggaatccctgggaagatccaggatttctcggcgcgcttgtcccgattgggaactgt

SEQ ID NO: 1500 - DNA, 528459 bp, Homo sapiens
tactgggtaacttgttaaacacatttattgatttcttgacagtaaccaaacacagtgagtgaccattataaacaagaaaagaaaggcattcgttttgtactttgtgagatctggctgcacctggagagaaaacatacccctttcccaggaacttacaaggcaaagtgcattccttcacgggagcatcacaggggggcatggcagttttgaaacgcaagaagtctgtcgcctgctatctcaggctgaagctcacctcatgtgaatgattgagccatggagtggaattaaagtcatacttgcttagcaaatgcattcctgattgccacaaactcagtaaaaactggctgcaaatgaacaaaacatgtagatgaaggaacaagtgaaatcaaagaatgcagttgcatggagccagggcttagcctgtaaggaaggagaacagaccaaagccagaaaaatgaaattaactcgttaaacacatttattgagctggtaacaataaccaaacacaatgtatgacctttggaaaacaagaaacagcaaatggatcatttctgatcttggcaaatcctactacagatatgtgacaaagagggaaataattccatttccttatagtctgtggtgatatatatacaatgtgtagctcttcaatgtctgtcctttttttctttgtaaattgttgagtaaacagaagaatcataatctagaaataagtgtccttggtcaactttgtcctgctcacctgctaccagcaccctcaaaggatcctaggacactatctgaaattacttgatgcaaagtccgtttgatgccatcagagctgtattttctcctctctcttttggaagaattttgtatgtacaaaggctgaaaagtctcattgggtagatttattagttcaggaaaacggtatcaaaattgaaatcaggttaactggttattttcttctaagacctcttatgaatgagacttttgtttctgaaacttgacttcccatgatggaggttgtaagagtgtgtgtgtgtgtaggtatgtttgcatgtgtttgtatgtatgtgcaagtgcttgtgtgtgtgtttgtgagtatgtgtgagagatgtattcctctgccatggttttgcagacacttttcatgaagaaagggccaatcccaagaatgaatgaggcttgggggaaagaaggagagagaagcaagaagggggacattctaggttacgtcaattcacagttgtagcatttcactgaggtgggattcttcttggctttgttccctacttgaggagccattcatttactgcaaagagagagaaagaaaaaaaaaatcacacatacaacataaaacgaggcatactcaattaatttgcacacagttttagagaattcctccagaggggaagggactgttttgtaaatgcctgcttacttatatgcattccaactactcccttccaattctccatgaccttctaggcctatactgaccaatatggtggccactagctgccatatgtggctactatgaatttaaattaattaaaataaaaaattagttgcatcattgtactagtcacccatccaatgttcaatagccacatatggctagtagctgctgtattgggcagtgcaggatagtcatcaacctatcatgaaaacattcccattaccacagaaagttctagtggatgacactgctctaggctagggatggaaaaacaacagtccacagatctaatccagcacaatacctgtttttataaataaagttttattggaacacagccatacccattcatttagatattatcaatggctgatttcatactacaatgtcagagtgccatagagattttatggcttcaaaacttaacatatttactctctgtcctttatagaaaaagtgtgtagactcctgttgtagaccatatgctctgtttggataggtgtcttatctgtcacccatcacccagctaactgacacatggtaggaacacaatacaggggttttgactaaagagaagaagcaatgaatgagttaggtatttacttttctggtagttccggctggaagggtgtggaaaatatgtagtttgggcatgcaagtgtatctgagagagaaaaaagaagggaacaagggggaagtaggaggaatgaagtggaggatcaaggagtagtggtggaggctgcttctaaaagctgtctggtaataaccacagccctcctatttggggagcatgttattgctacaaagggcttccctatccaggctcttgtttgcttcctttaacaaactgtgaagtagatggcataggaactgtcacgaagaagccaggtctagggggtaaacaatgtggctgggtttgcacagcttgttagaactaggcccagaacttgggtgtcctgatttccagtccagggctctccaagaccccatccttcctccatctttctttccacactgagtgtttaccacaatgattaacagatgtttagtagtaagcagaagggaagagagagagggctgggtgtgcaccacagagttacaggaggcagatgtcaacttaaatgtcccctttagtgggaataataaccatttctagggacatagcactgggcaaagatacactcacaaattaccccattggattctaatggcctgccctttagagtatttgttcatcttctaggggaaagcaggtctttcttccatatacttaaaagctctaatgcttttcactgtcctgttctaacagataaccttgggaacatcagcctttctgggctcttttgaaaaatggcaataaaaagctgtcttgcctgatctacaggggttttaaaggtttgatatatgtgtttaaaggttacatatatatatatctcacatatatcaaacctctacaccttgccatctacctaccgtccatccatccatccatccacttacttacctacctaccaacctacctagatgcattcatacaggtatctgtatcacatatatcaaaactttagaccttcatcaccatgcaaatggagtgtgatggctattgtcatttacagtcatcattcctataatggaagataatgccaggcctttaagaacaggtctaagcagaaagactgagctctagcctagatcctccactctctgagccaccaaacccacctctatactgaagcttctgggctcggttgtttggacagtccttcccctgtaaactgaagttgatattggtgcggatgcagcggttgttgagtggctggacaggcctgaagttgtcactcatgctcagaaagatctgagatggctggttctggctgagcaggcgcaaggaatgcatctgaggagagagaagtggccgtgagatccaaccatcctcttaaatgcactagggaagaaataagaccacagagactctggccaagctaggtggtattggctgtatgaggaaagggctgtataagccccacagagtcccttttttccatgggttcagttgagctgaaggcccattatacctccacacatgaagccagcctttcttctagcttactagcttgtgtatgcctctgaacaagtcacttgcgctctctcaccctcaaatgcagcatccaaaaaaggagcaaatctggttaggtttctctaaggttctttctttctttgatactctttggttcaataattccatgactcccacatggtattacgtggatcatagtgattggtccatgggtcagagctaaactaagctggaccagtttggtttcttttctgtgagactatgagggccaggtggctggactgtttgcagccatgttctgccacaggactgtgaggcaaaagaagacggtctctagcaggagagaagaatgaagtgaatgtgtggtgagaagaggacaacagagagaaagcacttctggggttcccatttcagtgaatttctgatgtcaatttctgattttaaattctctaagatgccctcgtagctctcaaataaatgctttttctaagcttaagtggggagttactgttgcctgtcacccagtgggtcccattcaatacagataggttaaggaacttcaaattgttcaaatggtggtcaggtgggaacacatatcccgtcaaggatattggcttctgcttcctttgctcatctctcctttaatttgttatagactcccacagtcgtagaatgtcagagctggagcaaactcatgtaatttatccccctctcaataaagaagaggagtgttcatttcatagaggtgggtgacaggcctgaagagcacaataagccgtgtagccaagctcacacaggaggacccatctgcctcccatccagttctgatgagtactaactctgtgagatgatccaaaaaaaacactgcacattcaaatatgtgtgcaaaatactacatatcataccacttcctcttgaagactgacacatatattagcatttaagaaggaccccagaaatccttcaacaatggaatctatttaactttttaaaacccaactttttcaaatgcataatgacatcttccattttgcttgcttgctttctgaacactgtagttgtagaatacactctgggaattaatggctatcttttcccactgagacagttgagatgcttctataattagctcaggctaagccttttggatgctggctctttaaacccaggcatatgggttgaatcgtgtacccctgaaattcataagctgaaggtactggtaacccctagttgctcagaatgtgaccttatttggaaatagtcattgcagatggaatgagctaagacaagcttattggggttaggctttaatggaatacagaaggtgcctttataaaaaggggaaatttggacacagagcctcagacacagggagaacaccttataaagatggaggtagaggctgggtgtggtggctcacgcctgtaatcccagcactttgggaggtcgaggcaaatggattacctgaggtcaggagttcaagaccagcctggccaacatgatgaaaccccatctctactaaaagtataaaaattagccgggcgtggtggcacgtgtctgtaatcccagctactcaggaggctgaggcacaagaatcgcttgaacccaggaggtggaagttgcagtgagccaagatcacgccactgcactccagcctgggtgacaagagcgagactccatctcaaaaaagaaaaaaaaaaagatggaggtagagcttggggtggtgcttttaaatgccaaagcacgtcaaagattgtcagcaaaccactagaagctaggggagaggcatggaacagattcttcctcacattccgctgaaggaagcaacgctgctgacaccttgatcttggacttctagtctccagaactgtgaggcgataagtttgtgttagtttaaactacccagtttgtgggactttgttatagtggtcctagtaaactattataataggcactccacatttcagtgatttttttttaacatcattcttctccattagctaaatgaccagagagaaactcacctgcatcctggttatatagacaggtttgttcattatgatccaacttgctgtctcatagcagggtgggatagtcatcgacccatcgtaagtgatgaaactagaggtctctggatatagttcctctatattaagcccctgtagtaaatatgcatcatctagagaaggaaagaagacttaaaaattaggtttcttgagaaagggatggtattgctgacatacatacatacatacatacatatacatatacatatacatacatatatacacacacagatatatatgtatttcttttggaattccagaagactctatctgtcagaacaggctgcagtaacaagcagttgtcccccagatctcggttgttttaagcaataagaatgtatttcttgctcacacacatgatcattccaggttggctgaggcttccctccatgtcattgtccatgctttgggacctagactcttagagcagtaaacacctggacctgtgcggatcacagtgacagaagcgaaagcatggcgaatgtgtgttggttcttaaaacttccatcccagaagtggcacacatcacttgtgctcatgttttggtagccaaagaagtcacatggttaaggctgatgttggggatgcgaggaagcacattccttccacaggatggggccctgagcattggtgagctgtaagcaatgcgttctaccacagggattgtttgaggagtccttgattctagtccctgagatctggactcctaggcattacaggtatcatgagatggacaattaaagcttctagacctgttgaaattcacctggtgaccattctcacttaaaacaacaataagaaaatatttttggatagaaaagtaaatcaggccaaatcctaccatgagattctatggttaagctcaacaactgattattttgtgtgtgtgtgtgtgtgtgtgtgtgtgtgtgtgtgtatttttctctctctcaggtctatgcagatagccttttctcttacaccaatttgaggtattcatacccatatatcttctattactaaatacagtaattcaatggtaaaaatgacataagtacatcacagactatatggaaaaaagaaaaaacaatttcagtcatctaaaactgttactattagcattttggtgtgtttcctgttaatttttttagtcaatgtattggttgtatttttgataaaattgtgtgtattggagttttaaaatatcagttaattgcaatgtatctctcctcttctcccctcttcatgatccttcttcctttcttttagcacgtgattgttctcttctgctggcttcaaaaataccatacttagtattcccatttttctggccattctctctcaggttttgttgctgtctcctgatcttctacctgcttctctcaatgatgcaattccccaaagatcagtccaaggctcccttcttttcttactctatcctctcatctgagagtagctcatctacatccatggcttcacttgccttctgcatcccagtgattccagatctatatctctagaggtatcacatccccaggcataccatgagcacccatcactgtggccagtccaggagacctggagaacacatggcagggtcccaaagcctggctggccgagggatgagactgactctccagccccatggatgcacacatgttctctcgtccatgtgtctaactcccagtgggaaagtactcattcttcaggggttgagggaacctcttcagtttagtattgtgcacatatatggtaaaggaagactttcacatatggctggaacctcacattgactcaataaaatgagtcaggcagatagtaacatcctccactgacaagaaactaaagatcagggaggcaaagtgggctgcccaaggtcacagggctagctggtgactgcaaagtggaaattagaactcagctcttccgacctccagaccaaggtcattttttcattcaacgattattcactagaacctctttgtgctaggcacagtgttaagctctggggacagagcaattaacaagatagatgcagtccttgaccttattctagttggagagatagataacaaatggcaaaataaaaataagtaggctataatgtcacagtaataagtgcaccttgacctgcctgtacttacctactgattaatgctgctaatttattttccttggcaaagatgccctctcctccatttcttcctctagaaattgctcgttcagccttctccaataagaaagagttacctttgccaagggaacttgaatttcagtgttgctttgtcaattaaattgtgaacaaatcaatggagccaatcgtttggaatgatataaatacaatcacaatttgcctactccattcaaagctgcccttcctggcctcctactcccttgatggggtaagggaacccctccagggttccatccaccaaagtctctgaggaagatagcttcaccaagctggatttggagaccaaccctaggaggaaggactttctttcacttttcatttaaatgtttctacctttccgtcaaaacaccaaggaacgaggacatgctcgagagagacacagtgattggaatatggccagcctgggtctgcactatggcctgtttgggcagatgcttccataacaaagccacagtgcccagggcacacacgacgtgagggaccttgggggttacatcaggggccaacccaataagttaacattggatatcagcatttgtctctgactgcctcttaagtccctaagatgtgtcaggcactaagccaggtatagatgagtaggaaataattaagtgaatgcagaaggcatgacagagacaatgacataaatctgcattgggcccagagagaggctgtgagttctgtctggggcgagggtgcggggtactcaggaaggaatgaatcgaggagttgacttgaactgcatctttaacagcaggaggtgatcagtttgtagctgggaatcgggtagggtgtcaaggccactgtagacagagcaatgctagaaaaagagtcaaggaaggagtggtgtgtacttggggacagatggagtgtgaggtgcagggcgatgtggagatggaaggggagggagggctgctgtgagaaatgtggctggtggggtcagcacagaccacaccagaaggtcttcccagcactactgggagtttggacttcatccggaggcaatgcggaaccaccgaagggattgaagccaaggagtagcatgatcacatttgcacttaatgaggcttgctctgatggtggtttggcctgaagattaacatattgaataagagaaggaagcattcagcacatttttgttaaaggtcaatgtgatttgtttaaccaagcttgcacgaggaacacattgggtactctagcatgctgttattattgcattttattttattcggggcggtggggaggagtgaagggggaagtagaaagagaggcattccaggcatgactggagtaaagaaaaggaacatgttttgtttctttgagactgtaaccagcctttgtgctgcagctatatttgtggaaaagattgggggccgaggtatagtgtaggctaggagcaagagtcaaaggttatgctcagggatttatcacacacagcaggtttccaaaacaccgtagtgctgataccccagactccatccactgaggtcctgccaggagatccctctttgtccactccctctccaagatgcaacagtcatcagaggacataggcagcttctgctctcctgacattttcactccccactgtgttccttctgcaaatcttgttaatacttatactctaccttttgccctttttatatcctcacacagcagaacttggaaagacccagagtggagagtgtgagttttagactcacatcgcagttggagtgctgactttgctgctcactctccgtgtgtccttggacccacaggtaaccctctgagcctcagtttctacatttgcaataagcagatggttggagtactttgctcacggggttgtttgaggaataaacaggatcatgcttttcaagcacctagcataaggtgtggtccaggtttgtcacatcctcctaccctgccctggaataactactgctcctctcctcaaggactccctggcttccccagctgggccagtgccctccttttttgctgtatttactgaattagcttgtcaatcattatttgcctatttgactgtccctgctaagctgtgagccttcaggggaagggtttgcatcttgtatctctaagcccccaaatgccagcatgagtccaccacatactgggtgtttagtaaacactgctcgaatgaacaaatgaaatggtttctgctcagcagctctacctgctggcagtgttgggcaaaagcaagggaggaagagacgacatcatttatcagatgaggggaagcatctctgaggctccagtcagcatccttagcttaaatacatgctgcctaccatctcccccctatgtctcacaccctaagacatcagggtgagattgcctgccctgtttccatctccatatgctattaccatgtttccataccaaagactcctctaccttcatatttacattgctgagtcagtgcgcatttaacgtgtaatgtttgttttcatgactcatcatgctgcctcagaggctgccattaaatcagtgtctatcttttaggtattgggatttgaaagccactggctaactttctgcatcttcttttctctctgttgaagcttgctttgtatgtttgataggacagaagcagagggacccaagaaaagaacatgagtaaaacagaagttttcagccctaatgtcaaggcacactggggtgttttcagggctaactaggccaggaactagcttttagtcacaaactatcttgtccttgcagcatccagcagaaaaccattgtttggttcttgtcagcgttatcgtctgggcattatagacagaaagtagactgaggaccaatataccagaagggagattctcctctctaaacttccaaggctctattcatgagtaaggatggcaaagatctagaggaggtcagagttgtttgtgaacaaagatgcaaatttggggtgaagctcagaggccagtgggggagtgttcatgcatgtctctgcttgctttaaggatgtttattggtggaagtgaggacagatgttcaaataaagtttcatgaatagttttgcagagaggtttctctacctatcccctctttctctctctctctctctcagctctctctctctctcctctctctctctctcatatctctatcacctacttacctgtcatatgagaaaatagcttataaagggcaaatcctagatgtcaagtcaagagtcttaattcaagtctgagttctagtggtagctttgccagcaactcattcttccttcatggaaaagaatgtaacctcttacttgaggataccaaacagtcctggaaaattgcatcttcaggtattaaacattctatggatccgaaaccatctttcaacataagcaagcttgttagccaaatttatcttaggtaggtcaaatttttatatgagagtgttgtaattttgtatgtgttggctgtatctttatagtaaaggaggaccccttggatcttgaataatcaataagtgtagaatatatgtgtgtattttatcacccaattttattatttcaaatgactgcagaagttgacagctgaacctttggttttttgacatgttcttgatgaacctgtgatttatcttatactgagttcttagtcgtggttacaactcccaagctgactttttctttttgtaggagacgtacactatgataaaatgcctaggaccacttgggggagtcgggggaaactttccctcagtctgaacttttttttttcagtctgcatttaacaggcagcctctgttaaatgcattgtgcttactcatgtggaccactgatgagatttaatattgcccggcttcctgcttatgaagttcccatttgaagagaactattccaatgagaacaaggcacggtagtttcagagatcaatactggacttgttcctgatcaatatggaactatttggcaattttctcatatagaatgacatttcctcttgtaatctgaggcaaattcaactgaaatgaaaaaaggcaattactaaagaatgaagtaatatgatattttgttttacacaaacaataaatgataaaagggacctctgagaattggattcgtggaggtaagctgctcctgttctgttccttgctgacgtgagtaactacttagattgcaacatggaaagtggtgtgctgcgttttgcattctgtgaaagcatttccaaagccgttcctttgaaatgaaagtacaagttcaattaagcatagagaaaggcaccaggagcaatatgcttaaactccttggtgatatttcgtcacatttaacaccacgtccctctgaggagcggcgcataaaacacttcccaaagaactgagaagtataaggcagttccaagttgatctgtccttgcctacacatgcatcttttagctgaatagaagatctgggggttgggggaagtaaagcaaagttataaacaggtaagactgaaaaagatgctttaaagggcttgtgccacgtgtcaaagcgctgaatctgaaagctctcctccagatgccttcagtggtgtggttttatttccttagaggaaatacattaggacaatagccatatctttttttttccttattttttatttgagatggagtcttgctctgtcgcccaggctggagtgcagtggcatgatcttggctcactgtaacctccgcctcccaagtttcagtgattgtcctgcctcagcctcccgagtagctgggattataggtgcccaccaccatgcccagctaatttttgtatttttggtacagacagggtttcaccatggtggccaggctcgtcttgaactcctgacttcaggtgatctgcccatctcagcctcccaaagtgctgggattataagtgtgagtcaacacgcccagccaccatacctttttaaatttgaaatttgtgatcgtttggattcttattggactaaatgaatgggggcatgcgacactgaaggagaatgaagctaccaaaataatactgtcctaagatgttagaggaaagtgttttatatgcagtgttctaataactgttccctcttacccacttaagaagcctctttgcacttcattggtcactagtttagccacttgaaaacagcataaaatctctttttaaaaaataatgctggcttaatgaaattgggtagataataaaataagaatactactttttatttaattgggattctgttaattaatgccaattaattaacacaagaaaaatggagggatattagccttattccaatacactacgttaaaaaattaaaatacttcaagtaaattaccaatatctcctccagaaaatccattcggaaaatctatttttcaatgtcatgattttagtcttaacccccagtctgttgaaggggaatttgactttaataaaatgggttttctttagaagactttctaaattcagcccgaatttagttcaggctagtttttttcattgtcagtcccagttagagtgttttataagtttcactcagacatatgaaatctaagcttgcaaggaaagtaaagtagtagaatctcattaaatcatcaccatccactgcatggattcaagcacaggagcggtatttcatttaaaacaagcaaattctgttgactctgtgtcctgtattgcatttaccttcaacataatttttatttggcatcatagcaacctgcctcctcccctgagggaagctggatttgatagccaggtaccttaagacaacttagaaatacacgttcattttacacctagtttataccactcattgttcaggcatttgactcattaccttgtttgattctcatgccaaccatctcaacgtcagcattaatatcttcctcttacagatcggggaggtgtttagaagcttgcttaaagtcaggcaacaaaaggaagtggtagagccaggataggagcccagatctctcttcactagaacacactgcctcccatgggtgtggtgcctttaccagcatggcatttagcctccaaaattcccaatcctcttggcgagattctccctctttcctccttgtatgaatttcctggcattgattttttttgtaactggctcaaaagaatgattttgcacagttccccccctttttttttttcctggtcattcattctgtgcccaatcctacaaaccgggcaaatggactgtgtctcttccagctgccatgttgtgatttcaccccgctgcctccatgtgtgcagcagctccctgcaccacctcagtttgctgatgaggcagccacacgggagcctcttccagggtgggattttaaagatatctttagaagtgattttcaatcctaagtcatggagatttgagttgctctttcaaaagtgaggacatgtcccgcctctcttctctatttattcttactctcaggatttcaccaacgtttaaacgccatctggatgccaacgtcttccacatttatatcttcagttctccctcctgaaatccagactcatatatccaactgcctactccacacctcttcttgggtaccttataaacatctcaagctgaacatgttcaaaatttctgatttccttcccacccacggatacgcttcatccacagtctccccatctcagtggatgaaaatgtcttctttccagttgctcaggctaaaagtcttacagtcatccctcactcccctctttctctcacataaaacatcagatatattatcagatatatcagtacatttcttggcttttttttttttttttttgacagaatcttgctttgttgcccaggctggagtgcaatggtacgatctcagctcactgccacctccgcctcccgggttcaagtgattctcctgcctcagcctcccaagtagctggaattacaggcgcgcgccacaatcccagctaatttttgtatttttagtggagatggggtctcaccatgttggtcaggctggtctcgaactcctgacctcgtgatccacctgcctcggcctcccaaagtgctgggattacaggtgtgagccactgtgcccggcctcttggctttttctttaaaatatatccaattatttctcaccatctccctgccaatccccatcagcccggtcatggtcagtgccatcgtctcattatttgggttgctgcaatcctcttctattgtggactctgccccttgtagtctattctcaaccaagcaatgaggcgatccttttgtcaacagatgatgtcactctgcttaaattcctagattgactttttgttacaatgaccttcaaggggcagattttcagaagactgaccccctctagaattaatctctgtgccttctctggtgactatatatgtcagtaatggcaatgtcactgtgtccctctgaatgactgatttccactggaggtaccatgttcagggccaggcaggagttggagagagcttaggtcaggatgtacttgaactgccaaagttcccatcagttctgtggttagtatatgtccctttcaagtggaggcacatgcaaatagcaaaaagatgcttcttcaaactgaaccaaagttggaattaagagaaaaacatgctgacaagtttcatggaatgtgaaaacatcttcactgcaattagttttaagaccctggagctaagctttccttcctccttagggagaaagcatgataggaaggaaaagcagaggaaacagtacccaggaagacctgtatttggatacttgctcttctactatggaagaatatttttcaggaaatgttcacttcttcctcatcttcatctccttggcaggattttcatgttgagcttggccatatggcttgctttggcttgtggaagtggacagagtgagtgtgtgagtttcatgactaggccttaagtcacatcacttatttcttccctctaccatgagaactacttgccctggatatcatcttgatcctagaacaatgagagtcacgtggagctgagctgcttcagctcacttgcagacctgtagctggaagcagagccacccctaccaacccaaggagggagcaataagaaatcaatgcttatcattgaatgcttgtttattacgcagaagttgctgactgatacagccattaaatgtgtgtcattggtcaaatgacttcacctcttgaagccttgatttttcccatctgtaaactggggatggcaatcataccgctctgaaggacttcgtgagcactaggtaaggagcctgtatgtaaagcatagaccttggtgtgtggaaagtgctcagtaagcatcatctccatattcctggggctcagcacgttgcagagtggatactgcatctaaatgagcagagcaaattgaagctatgctggggtgcagttctgggtagcaacagtagaatgggcaggggtggaggttaggtgtccctcagtagcatggtagaaatggtggggtggggggttgatttctgtctctcgaacatttagaaggacagaagcaggataccctgatagggccccctgagttttcttcatcttaacctgaatttatgggccagtgctggcctaacctgctgcctgttggaaagcctcgggagggacttccagtcttatgtttcccacccactggctgtgttctagtgaatgactcctactccagactcccctgcctgccactgggctaaccttctggctgccctagggacaaaagagagctgtggttttctgctgcgcaaatcaattcatttctgccgcagtgtcctgggcaaagcagtgtcagggtcattctcatgaatcggccatcattattcctgcagtgctgctcccttcaggtatgtgacaaaggtcactacagaggacacctcaattactccctgctgaattataggagcacaaaattcctgttattagggggcctaaatcagctatctttccccatgcaggccaggatctctttatcttgctttggctcccctttcttttccctgggccctgagaggtgtagagtatgggggtcagaaggagagggtgctcctgctgtcttctatttgcatttctaggaatgtgtcttcagaggtgaaaagggtgtttaaatgtctgcctgccttctgcataaacaccttaacatggctcaagatccggctccagaacatctttcttgccactccctctgccccgtcacagctcctgaaagaggccattcatccttctattcacccaggccatcaccaatgcttattgggcgtgcctcgtcttaggcactgagacgaagagctgatgaagacagagttcctccctctgaactcttcaccggccttcagtgctctccaggttttgtgcatgtggctccccacacttggaatgcttttccttccctccctccctttcttcctttcctcccttccatctgtcttttccttcttccctgcctccccttcctctccctcccctctcttgctcctcccttggtggcacaagccacatcacttaatattaatcagaccagtgctgggggatgggtggtggggtggggaggaaagtccctctaatgattgactctgcaactggtaatctgttagactgtgtgttggggcttaatgtgtgatttcatgcattttcacggtctctaaattgcaaatccaagattatttgaaaacattttatttaattttcatgcttttttcatcaaaaaagttaaaagaataataatcttttatgggcagttataaatgtgctatttacacacaagacagaaatatctcccttagctgagcaatctaagtgtgtgcttagagaggactccataagaatactaatgagaaaaggcagaatatgcttggagacaacctaattcattcttctgggcaatgtctctctaggtggagcgggattctccaggttcattcctcagccctaccagtctcccagcctctgcagatgggagggacttggcagtgagcacgtggtagttgtagggctgctgtctgggccatctttacatccctggagcttcgcttggtgcctgtcatggggcaggcatgcaggaaatgtttgtcgaataagtgagtaaacggctgagtgaagcattctccatactctcccttggcagtccaatgtgagagctgtacacattcatttttttttcttcacatcaccattggagagagaagcagcagacacagctgagctcctggcttggtgaagggcatgccaaggggatgtgggtgcttggatgtttgccaactgtttttcacttttgtgagaatcattatttacctattgcttgattcagaatcccagacctagaaggactttagaaacttgaagttcaacttttttactttataagatgaatgacagagtcaaagtgaggaaactccttgatgaaggacaaagccaggacttgaatcccagtatcctactcgctcctaattaggtaaagacaatcttttttcctcatattatttctttcatctatgggtgtgtgctgtctcacccaacttttcccaaatcctgcaccttctgggattgctggagatgacagcagcatctttttccttcctccttcaactttgcactgttctctcttttctgcataatgagtctggggataaaacactctggaaacccaaggaaactggacagagtcctctacatccatgggccacacatgtggctgaagagagatgctatcctgtctctgcctggaaaggagacccagccacacacagagaaatggtctagccgagggcttctgtaaatgttgcgattggatccatagtacctgatgagggctttctcaatcccgtaattggcaaagccccaactgtgaccagctgacacggtggagcgtgtcagccagcagagtcccctggctcattaccaatctatgggataacgatgaccaccatagtcataatcattatcaccttaggcatggatgacaaaggcaccctagggacttctgcttgaaatgagctgcttcttagccaaaccctaatctccagagtgactttctacagaactgcaggatcatgaaactgaaaagggcccatggagatcatcagttctggcttcccgccttcaggcaggtctaacctttatagaatagttgctgtggaggaaattgaaccaaacttacttttatatgttattcttgtgatagtatctctgttgagcattcgattaagaaatgggtttgatgaatcagaaacctggaggagaaaagaaaatattaatgactgggcatcactcttgcaggacaaacatctccccgtgacattcacttattcattcatagttactgagtatctaccatgagccaaacacaatgacagctgcaaattcagagagcaaagccagagtccctattctcaaggacagcccagtctagagaggaagacaggtaagtgaacaaactgttctcatatagtgtgaagagtgctatgattgagtcattggtgtaatgatgttggaggaagaccagccaccacctgagaatctaagtcatgagtctgagaggatgggtagaagttaacaaagcgttctggtgatagagtgtgaaaagggatgaaaggcaaggaaaagcatttcatacagaaaatctttacatacacggacatggggaagtgagaaccaggcatgctcatgcaaagacttcagtgtacttggagctgagggtatggggaaggataggaagtgagcctagaaagattggcaggggccagatcatgtcaggcttttaagcaaggtagggactgacatgttaggaaggggaaattcatctacgtagagggtgagacataaagagtacccagaatagaggtataaggaaatggaaaaaaaaaaaaactgaaaagtatcactgctcattattgcatgaattgagtatatcataagccatgtaattcaatcaaccaaccatccatccatccagccagccagtcagccagccagccagccagccacccacccaacaaataaatatttgcagagggtctattatgggccaaacattgtaccagatgttcagggatcagttcccattttatgcctatgcccttatagcttcaaattcctctgttgggagaagaaaccaggtttccaggggcttcagcagggaaccatcattgatgagactgtgatgtggccctacataagaaaagggttttcttaaaaacacctgtttactcagccttttctggggtaccattgttcatcctagtcatttctctcctaccttgcttagctctgctctgtaatttatgtctcagtggctaatcggatgttgtgacacatcaacattttaaatctgatttatctgagggttggaaaaattgcagcagatgattattattattagataagcaacaggtaattttagcttggagaaagcacagactgtttattttccctccatctgtctccctttttgcggtttcctggctgtgttgtggtgagacacacaccaaagggagcttggtgagtgacaatgcccagtggaggtaaaagtccatccctaaatagaaaaagtcccaaattgaatactgctgctcccctcagtgctatattcaacatctactttgacatcctcttcagccatttaaaagatagcttgaagcctgctcctggtgctgatgcaccccatgaaagaaagatggctaggaatatattgtcgtggcaggtaaggaatctgttatgtaccttacttcctgggtgccttgagctcctggtacctggtgagtctggtcagcccttgcgttgggagcagaccattttgagctgattaaaaataattgaaaaatttccaaagtgcacacagatgatttgtgggctctagtgtgttggctgcgtgggtgagaggataaaatatgtacttggtataagtgagcttaagtgggaagttaatggtgtgtgattgagcagcaattacagccaaatctcagttccctgtggtcacagcaagggtgggggatttgtggaggacagagataaataaaactcatagataagcaagtatctccttttagagagtaactccagcttttctacggctcagcttttagccagggtgataactctaggactaaactaccaggatgtggggcttgtcatatcccactcctgcccaccctgctgggaagggaaggcagagagttcagaaggaggggaggacaactacaagaggctgtgcacccttagggaccaagagctttgttcatcttacttctggataccagtgcctagcagagggctggcctgtagtacctcatgctccatcagagttttgagatgagtgaatggtcagtcacagcttaaataactcatggtggagttgattttctgggagttgattatatggagggaagacagaaatgttgtggcttattttgagatctagcaagaaagtttcaggtctgctcagggaaagaatggcttcatccctaggagctaaactgacctgagaagatgcaggagctagttattatcccttcactgacctcagggtctacagcctaagtttctttcaacagcctgtgggcaagcaactaggacttgcaaaccccagctgctagtcaccagctcggtaggaatgaacatttctgtaggagcttgtgaaacacaccagtaatttgttgttggcttcccagtgtatccgtcactctgtcagctgtcatgtgcctgtgcctccagaatgacagtcactgactcaagttttcagacacatgaggtaaagtcaggaccaaggccgagacactctccaaaggacaggaattgctggggcaggcaggatttgtgctgggaaagtcatagggggaagtgagctcctggacacacatgacaatattgtgacctatctacggcttcacagtgagtgcagcctaggttgaatgtacaaattggttatcaatgccataatcagggcttgattaagagatacaggaatttgccctgtgcttatgagtagcatggggttgtggggagtgtgggaagaatgttttaaaatgtcatgtactcccttcttgccctcacttgctctctcccagctctattggagaggcatagaatgagtaagccattctttcatgagtattaaagtcagggaagacttggatcctctcctggctgggctgttataagcgacatgaacttgggtgaaatcccaaaggttctctgaataattttactcatctgtaagatacaacacgaatgttcaacctctgagtttattactaaacaacaaaatagatgtaaaatacatatcatagtgtctggcattcagaaatctactgtttattattccagggtttgtgatgatgccaggagataccattagaatctgtgctgggaccagtttcctttgagatgtcatgtcaagtatcacaaaggcatgaaagcctaaaaatatgcttccctggccaaatgtcccttcctctctttgttaatgacaaaccagaggaggttgaggttagtggccagggatagcaacatgccatggatgccccatccagcccctgcccagtgcataggtctgccctgatctgaccaaggggagggtgaggaagttaggagggggcatggcatggatgaccagggagggtgaagtgcctatggcacggggtaattcttttgtgggggcggggagagggatcagtgccccaggtgcccattcttctgagtaataatgatgtcatcatgacagccctgttaaaattccctggtggcagttttgatctattgatcatctccatcagattcccaattccgattggggcactttctctaatgatctggccaaaacatccccaggggctagcatggtgactgctaatgtttggaactgccacacattgcttttttttaatttttatttttctaattagaaaagcaatttctttttttattaaaaaatttgcatacctgcttctctctacatctgctaaaatgttaaaggtaattagtatttttttttaaacaaattagaatgtgattggttggagattttatgttgtcgttgttgactgttagggagatgtggagtttcctcaaaatgtcataaagtcagtgtgggtaatcttattaccagggaggcttatgaaggaacgggagagcgagagagaaagatgatgctcagagcaattgtgaggaagctggaaggagctatttagtgcagtgcctggaggggagagacatctcacttcttcctatgtttacaaggggcagctgaatggtgaacaggactttaatcctgtggggcattagtgagccacccacccttctagtattatatccttctgatttcactgcattaggtgggtcctaaagcctgtccctggatctagccccctttttctttctaggacagaagctgcttgaatcctcaggcccagatgctctgaaatggagattatcatttttgcatctcactgcagggggcctcatttttcataaatctcatgtatataaaaggcaccatcccatagttttcttaggcatggatagcaccccttttaatatttctaactccaacagagaccgtaaattggtattctgattgaggtggggatggtgagaagaatgaaggaatgcaagagacttacttttataaatatagaaactaccaccaatccatttggactctttgcagcttctgtgacattcgtatatagctcatggttatagtggatgagctgcacctggcaggagggaaaaacaagaatcagaacaataatccaacattaaaaggtatgaggcatagcacctgcccctacataagggtgaactgcaaagtatattgaggaacaatttggaagacaattttaattgaagggatttcagagggatgtgtgtgcatatgtgtgtaaaatgcatgtacacgcacacaaaaatacccatacatatttgcaaatgttttctggtaacaagcatgcttttcataagctcagagcccatctggctctggctccatcccaggacatttcccctaaagcgtgtgtaaagtgaattttccttattaggaacggaactgccctgtaggggtggatgttgtgtccctgctgcaccaccaacagctgccactggcagccagtaaatcttccttgcagcctcggagcaaacagggagctgttaggtcctgagtcagccatgactgggatgaaactggccagcctgcaagatgcagtagtagctgatggatcaggcttctgatgcaccagcctgtcccggtcatctggttgtgtaggactttatttcctcctcattcaataaggatcagtccacctgttgagcctttttcctgttacttaatttttttaaattcatttttaaaaatcgtgtataaacatacatatatgttcaaacagatgctccagcaatttttagccacatgatcaagttaccccacatcactgggatcaattgtttcctctgaaaaatggatatgatgatctttccttaaaattcatcatctcagggctgtgattttaaaacagttttttcttaacagtatggaagcctaattttttttttttttttaagttggagtctcgctctgtcacccaggctggagtgcagtggcgcgatttcagctcactgcaacctccgcctcccaggttcaagtgattgtcctgcctcagccttccaagtagctaggactacaggcgcatgtcaccacgccaggctaattttttgtatttttagtagagacggggtttcaccatgttacccaggatggtctccatctcctgacctcgtgatccacccgccttggcctcccaaagtgctgggattacaggtgtgagccactgcgcccggccagaagcataattttttaacaaattaaaatatagaagtaaaaaacgtgatgccccccccaccacctctttctaattctagtccatgctatacatacaactattaacagtttagtgtacatccttgtggttacttgttttgtgcttataagtcacacaaacacacatagcgtataaaaaataataaattccctagtccacagtaactgttaaaaaaacagaaagggatgattaataattatgattctgaacttgattttttaaaatttaaaagtagtttgtagctatctttctaagccaatgcatatagatctccccaagtcttccaaataactatagaattctcagttgcacaaacacccataacatatttaaccatcttctcgctggctttcgtgttgtttccatttttttgtctcttataaacaatgtcacagcaagcacatcatatatctttctgtaatggtgttagcattttccacaggctgatttgagaatccaataagatagtgcatgtagaagtgatttgtgactctgaaagtgtaagagagtactcattattgccaatatcttgaattgcattaaaaaaggtgaagttttagaagttgagaaatgtgatgatcaaaaaagatgcttttccttgaactttgagaaaaagaaaccatatctaacccagtggtttgctaccttcactgtgcatccagatcacctgggtgcttttaaagcccacctgtgcctgtctatgccttctcacattctgatttaattgatttgggatgatacttgtattcatcaaaagcttaccagctagagggaagttggacttcagaacaagtggaacataatcaatgaacattaatatcccatcaatgcctagtcagatggacagtaccttgaatctgagaatatcctgagcctcctgaggtgtagaggaacttctcatgaagagagcacatgttactgctgctcttgaaatatcctatttgcttattgctttttcacctatgagttttgccagtggagatggatgactctatagtagctactctgccatcagaaaggcaaccgcaggccaggcgttgctctgcctccgcaggacttttaatcccccctcccttgtacccccacacaaccaggactttctgcaggtggagaaatgttgccaggtggtggaagaaccagggactggggggttctcacacactcagcacacctcccttccagtgctgagtaagcttctaatgagaacaaaacacaccctgccatctgctaacttcttcccactgatacaggtgaccaacaaaactgccaggggatgtgccagtgcttccagacatgccttgaagttaaagcatgttctgaacagaggagggacatgaaaggcaatccagtggagtgatccttctgtccagcttgcaaggcagaaaaaggcaggaagaagtctcctgggccatgggctgcctctcagggtggggttcttttgggagccaggaactgtaagaaaggagctggcaagtacagggctgaggctgtgctttaagcttgagttaacacatttaaaactttgatctgaagtcatgcctcctctctgttccaaggtgagttggctaggattctgatatcaggagctttggtttctattagtagttgttgatggactgtctattgtgttaggttgaaccacatgaaattgatcttttgctttacaaaactggtgaatttatagttaatacattctagaaataaagctattttgaatatgagttttgagcattttctttctgacccccagtcagatgttaataagatgacagtgtgcgctctagggatcagcagcagccacagcatctaggagcttgttagaaatgcagaatcgggagccccatcccaggtctcctgaatcaagatctgcattttctcaaattcctagtgatttggatgcacgctaaagtttcagaagtgctgctatagcagatactgttggctggtgagcagagtcctgttttgtctggctgtttaccccttctccacttcaatttgggtgggttaaggagcacatgcatcacctatgttggaaaacaggctgagtccagatcataggacccctggaatgtcagcaatagaaaggctttgagcaggggaatgagataatcagcatggactgtaagagggtagattggagccaggagaaaatagaggtggaggttggggggtatttaatttcagatgatggttattaaggcagagatgtgctctataggcctttgcagtttacagaatgtgtatgtttgtgtgctgaagaggcaccaggagatttccccaggcaacagaacatctaggagcaacagaagagcacaggagacagcttgacagtcaccaggctttttgttctcagctgtaagaacacagtttgggcatcaaagataacctgggacctgtatcagttcatgcatgaacagcaggtcttaaccatgaaaaagtgctgcttcctttctactgccttccaggtctttgttggtggtgatcacagttcctgcagctgttgcctttgctcttccctagccaggcacaataatgctaacccaatacccactaaccactcacaatatgcatgggtccaggtgggtctggagaaaagcagggttcactgcttctcctaccatgactttgggcttggggagcagcaatgtgcaaaccacatcctgctagggacagagtatcagattggcagatgggttctgaaagtgatgcctgtggatggatttctttttgccatgtataggtaacacttttaaatctcaaccatataaagtctgaattttgaataatttagatgggccctaagctataccttaactgagccccaactttaaggcttatgcagagtaatcacagtgtctgatgtgaaacagatgatcaataagtgattgttcaactgtctgagcaagtgcatgatttgactaagactgcagggacaatgagagcaaactcttcgggggctaatgatgacatgctaattaaacaccaagttcaagttcaagaatttaagctattcattaaagagatgccttgagggcttctgctagtttagttggcattaccatgtgaaagggttaaacctggattcctggaaattatttaataatcttgattttttaaattagttttaggcgagtatcctcctagagaagcttcctggaaatgcaagactgagaaatggcaggcagtcttccagggagaatactaccagtcttgtcatgatgctcccacatggctggtgccatgatgcagtgcattctctatatctaagaagtcctccatgatctgatgtgacttgacttctcatttcagaaaggccacctcacctcaatcctttacatgggcctggaattcatttgttcaaaaaatctttgagggccaactatgtgctgaggtcaattggaataagactgagaaggtctttgtcctcctagagatagtttcagatggtggcaaagatagctttgaaggaaacaaaacaagattttgacttacttacagattgaaaggtagtagtggaaagaatgggggcgaggatgcagaagtgggggcaacattctgtagtatggttggtgaaaagtctttgggtaggctaacatttgagctgaatcctgatgaccaggagccaggtatgggaagatcagagggaagcatatcacttgtagagaacacggccaatgcaaagagcctgagatagggacaagcggctaggaatggctgggaaaggatgaaggtggctcaagatgggaccagttcatgcaaggctttgtagaccatggtgaggagctttgattttattccaaacacaataggaagtcacaggtgttaaataagaaaccaattgatctgatgtgcatttttgaaagatctctctggtgtggaggagggcaaagtggggactgaggaagccttgcctacccttctttacctcatagttcagctgggattgtgcccaattcctgcgactatttgagttcacattcaagcacatgctattttgcaactattctctttgtgtcttaccttctccaggacaccttccatgaaacactgtctctgaacaccaagtgcagctcccttctgctctcatgatgctctcacccaggaggcaaatttgtgatggttaattttatatggcaacttgactgggcaaagggatgcccagacagcaggaaaaacattatttctgggtgtgcctgtgagggtgcttctagaagatattagcatttgaatcagtaggctgagtaaagaagatctggccttatcagcgagggtgggcaacatccaatctattgcaggtatgaatagaataaaaaggtggaggattctctcttccttcagctggggcatccctctttctttgcccctggacatcagagctcctggttcttgggccttcagattttagactctgggacttacactagcgaccacctctctccctgtggtttgggattggggattacaccatcagcacctcctggttctccagcttgcagactgcacattgtgggacttcttggcttccataattgtgagccaattcccacaataaatctcctcttatatatctatgtatatagcctactgattctgtttgtctggagaaccctgactaatcaaaattcaaaatactttgcaaccaaaatgggatgggtaccgggtgatcagaacagatgtaaaccatagacgcccagtacagtcacatgagtgctgaatatcattgttaaagttagtcatcatcaccactttggatgatcattaccaacatttgtcgaacacctctttgtgtgagagacgatgccagcagaaacaactcatttaattcttgaaaacttctatgagttagtgccattatttccatttgagtcatggggacaccaagcctctgagagatagtggcagaggtgggattgtgcccagttcctgtgactatttgagttcatactcaagcacatgctattttgaaactattctctttgagtctgtgtctacttttgggtaaacatctcaagggcatggatatccatcatcacatccctggtgatgggatttggctcagaggagatgttggcaagcatttgctgaatgaataccaattctgcatctcatagaatcttagaaggggtcttagagaaaatcaaggtcttagttctcagcccatgacttttaaaaatgaagaaaatgaggatcaaagaggagctatgtcttgcccatgattatacagtcattcatagatccaatcattcaacatgtgtttattgaacaactcctaagtaagggagggtgatatgacgagaaattgtattggaaggcaggagaagaccatggagagcttggcaggccaaggtagggggtcttgattccatcctaagggtaacgaagaatttcacttatgtcctagaattttcttaggaccagaggcaaagtttctcctatgcacttaattgaagtggaagcctgaaaaccattggcctttggtgaccggtaactcagctttcaagctaacagacaagtactcctctgtgttaaataagcagacctgctgcaagaggcttccaagttgacacaagccacacttgtcataggttaagctgggagcagcttcagttgcacaggtctcagagttttcattttgtggtagcaaggtgatgcactagtgcatgccgggggctgctcactcacccctcatgcctcaggagggcaacaggctgtgttctcagaccttagatcacctttctcagcgtgatgctccattagcagaagcccttttgtgagcgcaaaagagcagccttggaacagaagaccacacgtggcgttcacagtgacaatgctatcaccttacccctgcttaaacacctcagtggcttccccttgcctgtaacataaagatgcacatctggggcccctggcttttctaaccatgtgtccttgttttctgtgctctgctcagtgtctttctttcagcctcccttatatactgggcttcctcctttcctagaacacatgcttattctgtttcttatgcttcccttcccttaaacagagaagggagggaataaacttccctcccttcactgtttgactcctacttatgaactcctttgtatctcagctcaagggtcacctgttgagggagatccccatgatccactgtcatggcactctgtacttttcaaaatacatatcacagttttagcttgacattcgttgtgtgactgatgaatgctcacctctttccctagactgactttaggcttcatccaggcatgggctctatcttattggcccctgtgacatctcctatacctggtacatattaactgtatcaaggcagaaataaataattgttaatgaatgaagcaatgcaggctgtctattgtacaatgaagtgtgatgtcccaagggacagagagaacaaggcgcttggctgaactggttaaagaacagtctggaattccaaaggttatctctaatgggaaccaagacactgagtatcacattgggctgcgtgggttgcaaagcctggtttcacccttgggtccccttacatgagcaagtctctcatctataagagggatagtaataattcataactaatactcatagcactgtgtgatgattctataaaaccgaatataaaaaagcacttagcccaaggcctggcatgcagtaaccattccatagtaagctactattgttgttgttatgcaatatttattatgcaagcaatagataatacagccttcagcttctgcagaaataggggttaggtatgtgcaggtctcctttgtggatccgacattgagtctgttctcccaaggaaacttgaggaaggtgtcacctattggggagcacccactgtgttccagacactgaatgaggcgagaacttttaaagagaaatgcattccgaatggctcatactgtaattcaggggtcagcagactttttcctgtaaagattcagatagtaaatatatttttctatgccaactgtatagtacctgtcacaactactcaattctgcttttataatatgaaagcagtcatggacaaaatataaaagaatgggcgtggctgggttccagtaaagctacagaaacacagcgtaggctagatttggtctgtgactgtagttttctgaccgctgctagtttaaatttgggagatgaataaagaacttccagtcatatattttccagtaagtgttctatacagataggaaaatacatgttgagagaacctaagcattaagctctccctttcctttaaatgatgatgattactattgttacctttatatagtcctttaaacttttcaaggcatattcaactcaaatgagctgaattctagtcaacgtataggtcccaaatgcccaccctatgccagatcccagaagtccagagatgaatgctgtatattccatagcctaaaacagctcacccatattaccacatttgttcctaaaataaataggtgaagtgaagacattaaggcacagagaggttaagcacctcttctgaggtcacacagacaaaaagtgacagtgactattcatttcacattagcatatgcaaatagtttctttctacaggaaagtaaagagaaaaggaaaggtgttctgtatttgaggggagatcacatttcagcagcttttgctggaacaactataagctagaacttatttatagaaagtcattaacaagtttgtcttcatgcataagagcacacacagtctgcagagaagaacacagtttgatgtttaccagccaccacattctcaccctaaggtttggtaactatcatgggtctgtccggtgatgagattttctgcattgtaggctatggaatgcaattatggctaaaaataaaaataattttccatagtttcattgacagaagatccccaaatgtggtctggctatcataccaacctagaaaaccagcatggaatgtaattattttcccccaaaagataacacaacttggattttaaagcatgtttttcatcaagttgtatgggagtttgcacaaatgtagagtgatatatttgggtgcaggatcatgctggaaaatgcaagaccttgagcctagtcagatacctcttctgtccaagtaatgtggggctacttatcccctctgattatttctttatgcataatatagggatgcatctatctaagaattgtcatgagagtgaaacaagataatgacacagtctttcaggaacttggcagggtataagtaaacaagataaacagatgagataaaacacataaagaatcagggaagttccgtgatgctttttttttttcccggaacttggaatgcgtttcgagaccactttttctcgattccttccccaggccttcgcatccttcaacttcttataaaggagctgctgaaagccagagtgggatgagcctcctgcacgacgtctagatcctcccagaagtgacttgtaggcagtggctgccaccatccaagaatgagagatgaggtctgcaggtccttttgaaacttctgctgattttagttaagcctatttcttccccatgctcctgcaacctcaaactcatcccaacacagggcatggatgaggagagttaggctctggctccaagtcctgggtcttctggtcttctttgaacttcaatttcttcacaggcaaaactgtgatgacaacataaccactcaaataatcgtgctgattaaatgaaccaaaacatgtaaatgagctcaggtgtacatgggataaaggaggcttcaaatgcagtgcctggcacaaagtaagccctcattaaatgggagttgcagtgattattattagaaatgtctggctgctggggctctgataaagggagaggccctagaatgatgaagtgacgtgttaagttccatagataacaacaaagtcaggccattcacactttgggactgtatttcttgacagtccatatatcattcacatttgcatcttactttatcttattgtcagatgactaccaagaagattttgccagtcttttctttctgtagctcgtattcttgtattatgaaaatagatatactgaacatgtctcataccaaataccttttctcttttaggattgttgctatttctgtggaagagtttgtcccatgagaaccactgtactggtatgtgtagggcatttttgttaaatattaagtcattccagagcccacataaatagtattaataaaggctcgctttgttttaattattgtagagatttaatgttatgtagttcatttgagttaaggcaagaattatttttggtcatctcctacgcaaaaaaaagcgttggtctagatgggtttataagtatattccagcagatatttgaggggaaaataggccaatatcttttacgatcatatatgcaaaaagccaaaattaatactagctagtggaaaacagcattaaaaataatttattacaatcaagtagggctcatatcaggagttaagggtaaatcaatgctggagaaatcttccaatgtgatctagcacatcaattgaatgaagcagaaaaaaagggacatgaacatctcaatatggagtacctgtatttagatagagctaaccaaattaacatccattttagtggaattacttctcacttaaatggatgaagtatacaaaaaaaaaaaaaaaatagaatctaatgcttcaacctgatgcctgggatgtcttttgcctgaggtctgagctctggagtgaacaaggaagacagcttctagatgatcatgagacaattcaggccaaagcatgtctctgtgatgctgagaaaggctctgaaagcttcagcaatgtggtgtccagagggcaatgtgattgaatgatatttcgggagaccacaatgcgaagttttatcctcttatagttattcataaaagtttatagcttcactggtatagatataactaaattggagaggaatgtgatttttcaaatatccaggggcaatgactctcagtacctgcagtagatgcacaccaaggggttgacggagaagacttttctagctcacttcacagttagtccccatcctggaggaaggaaagactgaatcctcacacactgcttgccaaagccatcttattcactcagggttaattcagaagagtcactttaggtggctactgtcctaactgatatattcatggaaaattagacacataacatctattagataacagaggagggttttctctcctctcataaatgaagctgcgcagcgatttggataaactgttcacaaaactaggcttggttttgtacacattaattgcataaagtatgatacttaataagcagaaacacacactggtttatttcaaagccattaaacccgcagtggattgactgtaggggatgaatattagaaagagcacagggctgggagtcaaaggggctgagtttgaatgacagctctgtcattcagtaggtaggtgtgctcggtgagtcactgctcccttttagacctcagggtctttatctggaaaacatggagattttaaggacagggttttgtcattcttctaaaacactgatgggaaatataggatgttgcctcttgagtttccatcaaagtcaattaagttatagtcacatgttgcttaaaaaccaggatgcattctgagaaatgtgttattaggtgattttgtcattgtgtgaacatcatagagtgtacttatataaacccagatggtatatggtatagcctattgctcctaggctacaaatctgcacagcatgttaccgtactgaataccataggcaattgtattgcacacagtggtaagtatttgtgtatctaaacgtagaaaaggctcaatcaaaatacgatattgtagtcttaggggaccactgtcacataggcagcctgtcattgaaggaaatcttgttaggtggtatgtgactgtatgtagaattgaaaccaaatatttaaaccaaagtttcagtaggcagcatgtttatgcctggggttgcaaatggatgactatgggaccaggctgcttgtctcaacagaggagaaggctaggcaaaggccatggccaaaaaatatgaatgtgcagcttagtcccagggtctcctggcagccactttgtgactcctggtttcttcatttgatcgtgcttaggtcaaatcaaaccaaatccaaacaaaacaaaatatctcaaaccttcactcattgattcttccaacaaacccgtatgtgtttcccatgtgccaggcactgtgctgggcatgaggagatgaaaagagggaagaccttagaggcagtaggaggcacatatgcaagtgtcctgtagcatcatggaagaccatgtgtaagaggaagaggctggagcccagaagggaaggggaatgaggtaggctgacccaggagaaaaaggtaaggacagaccacattcatgcttggagaccctggtaagaatattgtctatcctcagaacagtggaaagtcatccaaagtttgaagatggagaagggggttgtacgtgcaggggtagggaatgttgatgacagcaggtttgtttctgacactcgattgaaaactctagagggaagtgaccctttactgtagcgccttttctcaatgtggtgtctgattcttccagaaatcacattaccaactgcctgccaactttcccctattcctgcccttccagagcctgcccaggttcttggtgagccaggtattcctaatcctggaatcatatcactcaaatttaataacctctctcatgtgccagtacttgacaagttaaaagtaatttgaatatctgagtattaatattttaactatacaaggcaccacaaattatttagtgattttttaaaataaaaaagcaaataagaaaatgatgtatcaattcagattgcagggaataggagatcccaacacaggcttctgaaaaattgggaaaagcacccaagaagattataaaagatgactaatgagcacaaaacaacttttggcaagcacaggaaagtattagcttattccaagaaacaagacacatttcatccaattattggaaaataaatggcaagaaaaaccaaataccaagaaagtacccacatttatgtggaaaagtataaaagcaatgattcaggaactaatttgaacaatccagggatagtcatattgattccagcccattgctgcaatttgaaatgaagccaaatgccagaggacaatgagatctgttttatgggctcttacatgccacataggagggagggagccacaggaatgcaccacattgaaaaaggaattgtgacttctgatgggagggcttttgggccaagttaaatctcagaatccagctctccccctgctccccagacagtgttgctagaggtcaatggacagtggggtctgagcaagtcttcattgtgtgtgattgccccttgcttgcagggcctttagaacctttgcaccactcccactaactgcttgcagtacttccatcatgatgtcaatcccaaatacctcctacccagtttaaaacagcccttgtggtatatatgtgtgtgtactgcccagatggagggctgtggctaggaaagtcagtttccctatccgtaaattggaagaatgattgatagctccttgtgctacatatttctgctgagcaagcaaaaaaaaaaaaaatgaccttgggttagaacatccttcctgctgcactctgtgtggtcattgaatgtcacttctgtgcaggatgcagctgattcttttctctcctagtggattttgttttacagagggatctttggtcctgtgactgaaaggtgagttgggggtgacagtggggaaaggagacagaaggagggagagccaaattactctcactgtactgcagggaagtccagatggtgcccttgtcctaagcttccaaaatatgctctgggagggaaacagagacagcattttgctgacagcacttgggaacaggcgtgtgggcactctatattaagacttcaatatccattccaagtgtatctgtgtgtatgtgagagcactgtggctttacttggaaaccaccggtcccaatctctctggggcagattccatttttcattctttcctccctatccttgtaacccaggcccaaccattcagcaaagggtctacccccaaataccatggctccctctggggcctctgtcttttgccagggcaaaggttgtttccagtagaactgggtcagctagagggaaaggtctttatcccttgggtagccggagtctgaggcattcccaagggcgagtgggtacagtgtggttcccatccacagagtggtggcatgcatgccatgccagctactgtaccagggaggggcgatttcaagaagagactcagtcttggcctcaagcatttctcagtccagagagagagagagaaacccagctcttgcaggcagagctttataaattacaatgcatcttcctgcccacttcctttctgaacccaaacaatagcccttctgtgaattaggccaggatgctttgaaactgtctttcagacaggaggagctgaggacccaaagtcactcggttgtttatcaacagatctagacttaaattcaggtctctgattctcaaacacagtctaatttcgatctgtagacttggtcaagctgctgttttgtccggtgtactgtcctgatattgagaggtgacaatgtgctagcaacccttgctcgctctcgggacctcctcggcctctgcatccactctggccacacttgaggagcccttcagcccgctgctgcactgtgggagcccctctctgggctggctgaggccagagccagctccctctgcttgtggggaggggtggagagagaggcgcaggtgtgaaccagggctgtgcctgcactcgtgggccagcgcgagttctgggtgggcgtgggctcagcgcgcccacacttggagcggccggccggcatcacaggccctgggcagtgaggggcttagcacctgggccagcagctgtggagggggcgccaggtcccccagcactgctggcctgcctgcaccaagctcgaattctcgctgggcctcagccacttccctgtggggcagggctggggacctgcagcttgccatgcccaagaccctgcaacctcatccccgccgtgggctcccgcatggccttgtggtgcccggtcccatcaactgcccaagggctgaggagtgcaggcgcgggaccagatggcagctctgccgggcggcccagtgtgggatccactaggcaaagccagctgggctcctgagtcgggtggggacttggagaacttttatgtctagctggaggattgtatatgtaccaatcagcactctgtgtctagcttggggtttgtggatgcaccaatcagtgctcagtgtctagctaatctagtggggacttggagaacttttgtgtccagctaaaggattgtaaatgcaccaatcagcactctgtcaaaacggaccaatcagcaggatgtgggtggggtcagataagggaatagaagcaggccgccccagccagcagtggcaaccctctcgggtccccttccacactgtggaagctttgttctttcgctcttcgtactaaatcttgctgctgctcactctttgggtccatgccacttttatgagctgtaacactcaccgcgaaggtctgcagcttcactcctgaagccagcgagaccatgaacccaccaggagggatgaacaactccagatgcaccacctttaagaactgtaacactcactgcaaaggcctgcagcttcactcctgaagccagtaagaccacgaacccaccagaaggaagaaactctggacaccccatctttgaaaactgtaacactcaccgtgagggtctgtggcttcattcttgaagtcagcaagaccaagaacccgccaattttggacacaatatggtttggctgtgtccccacccaaatcttatcttgaattttagctcccataattcccacatgtgggaggaacctggtgggagataattgaatcacagggtggtttcccccatactgttctcatggtagtgaataagtctcatgagttctgatggttttatcaggggaaacccctttcacttggttctcatgccagctgccatgtaagatgttccctttgctcttctttcatcttccaccatgattgtgaggctcccctagccacgtggaactgcgagtcaattaaacctcttttctttataaattacccagtctcagcagcatgaaaatggacccttgcctgaccttcaatttaaaagaattatagtagctaccatttaaggagagtttcccatgtgccagcagggtcctcaatgccctacagaggtcatctcattcagttcttacaacaggtgtacaggcagggattactgtccccatttaccagatggggaaactgaagtgggggaggtgaaataacttgcttgaattcactcagtcagtaaaaggcagagccacatgttagacctggtttgtgggctttctcaccaaggattgtggggagcttccctgattgattgggtccgcattccttttttttttttccccctggaatctctgggacaccaactcatgcgtgaatctggggaattaatcttctcttgttgggccctggctgaggggttcagtgatccctgagctccattccagctctttctctggatttatctgtagcatccatacttccccaagtttccaggtgcttgtctcttatatccacaatgagtaacaccaccactagtgaattctagtgaacattattgggctataatgtgagccagggctgtgttagcctgttctgatgcattatctcatttgatccttgcaaaaatcgacgtatgagaaccttatcacctccaatttagagttaaggaaactgagccttagagatgctaagtaatgtatccaggtcacacagtttttaatagaacaagagcttgtgtctgatgccaaaaacaaaatgttaagcactaagttatctggcctctaatagacggaagtgctctgggacttgggattgtcaatcagacttagggggtggctaaataaatgaacccctgtggaatgaagtccccttgcactcctatagttagtgttttacttcatgtcagctgtggagaaataggcacagctggcttggtgtatctgtcagctgttaagtctcaggttctgtcttctaggtaggagctaccccaggcacagcactaaccctttcctgcaggttctgattgggggccggcctttggctcttcccggctgctaatgctatctccttcccaccttcaaggctccctgccctgagctgtccctcagggttctccatagtccaatcctgacttttccagccttctctcacctcctcctttacaacatacacctactgctgaaggggctttttgatgccccctgaacatgactcacagtttcacacatttgggtcattttttttgtttttgtttttgtttttgagatggaatctcgctctgttgcccaggctggagtgcagtggtgcgatcttggctcactgcaagctccacctcccgggttcacgccgttctcctgcctcagcctcctgagtagctgggactataggtgcccgccaccacgcctggctaattttttgtatttttagtaaagacgtgatttcaccgtgttagccaggatggtgtcgatctcctgacttcatgatccgcctgcctcggcctccaaaagtgctgggattacaggcatgagccaccacgcccggccacatttgggtctttatccatgcggtttgtctctaccaggaatggccattgttttggctgtaatttctgttagtggaacgcccctcctaaattgctatctcctccatgctggccttctggattttcctgtatgaatttgctgtcttcctccttttgaaatcttgtaacattaaagtaacattaaaatatgggcttgactgtgctttcaatgatagcttctctgcttgtagcagttcctccatagcctgtaagtagtaagaagagttacaaatctaaccctagccttgccacttcataactgtgacttagggcattgagttaacctgtctgaacttcatctttagggtagagataatactgtttatttccccagttgttgtaagaattacataagttagtgcatgtaaaacacctagtatccaccagacatgcaataggcactcaagaatcttaagttacccatattcccacatttcttattacctcttcccccaaatacacacagatcgtcacacacaaacaatactactgctgctaccaccaccacgatgatggctcaatgcccagtgtgtacaggatcacagcatgctagcgctataaagttccctagcagcccatggttttagtcactgttttgcaaacgagtaactagcacctgggttgggatcagctgccctaagtgagtacagtattgcagctaacatttactgggtacaacaccaaggcattgtacttggtgttttataagcattatcttatttgagcctcccaatgaatcccctgtggggttaggtaataacattttcatcacccctattttgcagagtggtggggggccgggggaccaaaacttagaggttaagtagtttacccaatatctcacttttctaataagttgaagagctagaatttggaccccaggagcccaatatcagatcctggctcttaaccagaagccagaatgaaagtgaactccagatagcctgcattattttaagagtcctctccagtgtctcagaaagggcttcagaaattcagaaaaagctcatttcttgattcccatgccagggctatctgcccaggggagctgaattgaacataaatgaattctaccagcccagatccctcaccctgccagtctcagtcttctcccggaaaagttaaaatgagttccctgagctctggctgctttctagtggggagggagttccagtggctttgcaggaggggagacttggaagaactccaccaacttagtttattccaaggcatgcccaagaaatggattttcttgactctgtcttggctgagacaaaacacacacctctcttgttggtctttctgagttgaacagtcttgtggccttaatgcctatcacattggatggtttcaggaaagggccattctttgctttcttggtccatgaattcagagctgggttgagcagtgatgagaaaatgaaccccctagccccagccagccctggatcctctcttgagttcattctcctttggcatttggtaagcaggaaccttgatgtcccagatggtagagccaagggatggccccaggcaattcatgcagatacctcagctggttgtagtgaatcattgtgtctatgcaagaaggacttatgagcactcagtgggaattctgtacttcaaatagcctattccaagtcaagctcattatcctgccaccctgaactctactccaaatctcctcctcttccttcatcccctctaacatggccatcatcctcccagtgctatatttatagacttgggcgcctactgagactcttttgtcttccttattcatgagagctcattagtcatgaagttctgtgaatttttgtaatacacttcatggttcttgcaactattgctgtcctctttatacccagtgctactgcttcagatcagggcctcaagtactctcaccttattattgcatcacttcctaactggtcttgctgcttccaaccttatgtctctcgaagccagtctctccatagccattgtgatggctctaggtctaaacatttcacttccctgcaaacgaaatccttcagtggcaccttagttccctatgggaaatgtccaggctcttttatccggcctgaaaggcccaccatgacctccagcttcaccattcacctccctgcccagcccacataagccggccatgccaagccactgcatggacctgactgtttgcacatctgtatctgtaaacacaccttcccctcctcctagaatgtccttcccccccaggttcatctggaaaactcttactcatccttcaaaaccctgctcaggcttcaccctccaggtagagatgctcatgcatgcctctctgctaccatcatgcccacaacatacctctattaaggcctctactgcttcatattgcaatgatttgtgtacagcgcatctcccaggtaaaatgagagctgcttgagggccagacagtggtttatagaaattatttccccaggacctagcacagcttctgacacaccataagcactaaatatactttgttgatatagatgatttttctgaattgatccaactgattcctttcacaagcacaaccactgcagggaagaaaaatagtcttcttacttaggaaaaaaattacttgacatgtcttaactgtaaaacccttgaacaagcactttatccttcttctgtggttactttttcttttttattgtgtcgctgtggtctggataaagttgtctgagttttattcatttcttaactctgattgctatcttgcaagggggatgggatgaaatagcaaacaatatattctagcttttttctttcccagaggcatatatagaacagcctctgaagaagtattaatattggaaaagatgctattatctgcattatactaattaatccatacatctacctgtcattctttcttttctatggcttttctcaccgcagtggtgtgctcttccgctgctggtaaattggcacaataaatctggggggaccacctctatttccagcagttcacttaacattttatcacgtggccgtggactcaggattgaagtcagttaaaaagattaataccatttaataccacccagaaggaagatgccagaagtctgtttaaggtcctgttattcatgtcttcatttcctttgtgcgtgtattgtgataagcatagccatcctttttaggctgctgctaataactacttaaaatgattaaggtaactagttatttcctgtaagaaaattgcgctgctgtcattaacacgaaattaacatggctcccatttcatcttcagcacacagcctgttgccccccgttgccttaaacaaacagaactgtctccagaaggctgtgcgctcctttgtaagaggcaaggaggtaagaaagcgtagttttgcagaggatgctgcccatggaggcagccggaggagggaaaagcatagtcccccaaactgccatgaggtttggaggagtaattagcataattgtcattattctgtatggcctgagcaatgtgaatgggatccgtgccctttaaaattcccagttctcagtcgggcatggtggctcatgcctataatcctagcactttgggaggccaaggcgggtggatcacctgaggtcaggagtttgagaccagcctggccaatatggcaaaaccccatctctactaaaaatacaaaaattagctgggcatggtgctgggtgcctgtagtcccagctactcaggggagaatggcttgaacccaggaggcagaggttgcagtgagctgagattgcgccaccgcactccagcctgggtgacagagtaagactccatctcaaaaaaaaaaaaaaaaaattagccaggtgtggtggcaggcacctgtaatcccagctactcaggagactgaggcaggagaattgcttgaaccctgggggcggaggttgcagtgagcctagattgcgccactgtactccagcctgggcgaaagagcaaggctgcgtctcaaaaaaaaaaacaaaaacaaaaaacacacaacaactcccaattctctcaatcagtagttctcttaggttggtgcaaaagtacttgtggtttttgccattagttttaagttttaagaacaaggaccgcaattacttttgtacccaacgaataagattttctcttacttgacacatgcaagacatttgcatgtgagagacactcccatcggaacactctgcttttgagaaggatctacacatatcttgtagggacatgaagcaccgtgatgcttgtaaggtcctaagtattaatggtaagtcagcaatggctgcttattgggagtcttggcacaaataagattggctagtgctacttaagtggagtctgtgaacatgtgtgtacaagttttagtttgagtacgtgttttcagttattttgggtatatacctatgaccggcattgctggactctgtacttttatgttcaactttttgaggaaccaccaaactgttttcctatattttaaagttgagcacttatgtgtgccaggccccgagttgaagagttcacgagatagtgtacttggagggtgaacatctagagccaggaggagaccagagggccaaagtagttcaagtcatctttgggaatctgtcacagttgtccctcttgctcacttgctcttactcctctaccccactctgattgtctgctgtgagtggcaccatcagcacagccatcacctgagagcatattagacatgcagaatctggggccccacccagacctactgcaccagcatttctgggggtgaggcccaggaatctgtttttaagaagccctctaggtgtttctgatgattactcaagactgagaagctccgagatagatgtaggtgcagtgttacccttgttgctcttacatcagaaaccctattggctgcaaagtgagcgtcagatactgcttttagagatagcttttagtcttctctaacttaaatacagtgaatcatatgcaacactccccacttttagcaggttatgtgcacccacttcacttacaactgcaaaaccctaccattccaggcagagtcacctcggttccatatcatgtcaggggctcttaacttgtcacagtagaaataacccagggttatcttagtaatcctgagactgtgctcttctttaccacccaggccagcctgcaaatgtgatgatgggtctaccacagagtccatggccacagagtagccctctgtggcttcctgacagccaagagcagcctcgatttgatatctggtgtttgttttaagcctttcctttttctgctgtcaggaagtggtaatgtagtagtgtgttgaaagagcatacattttgttgtcaaacagaccagggtttgaattctgattctgctacttgagcctgcaaaatgggttaataatatctactatgtggaataatatttgttcaataaatggtggtgatatggtttgggtctgtgtccccacccaaatctcatgttcaattgtaatactcagcgttggaggtgaggcctggtgggaggttactggatcatgtgggcggagttctcatgaatggtttagcaccatccactgtgggccgttcttgtgatagtgagtgagttatcatgagatgtggttgtttaaaagtgtgtagtacctcctcccttgtgctcttcctcctgctccagccatatgaagaggcacctgctcctgccatcattgtaagtttcctgaggcccccccagaagcagatgctgccatgcttcctgtacagcctgcagaaccatgaaccaatgaaacctcttttcttataatgtacccagtctcaggcatttctttatagcaatgcgagaatgaactaatagaagtggttactgctgttattaatcattgctgataattaaaaaaaaccaaatatgtacataaaaagagggagacagggtggagtagagagagagagagaactgtcataaattcctaaagactttttgaactactgtggccctctgtctcctcttggctctagatgtttgtcatccaagtgaactattttgtgaactcttcaactcagtgcttggtacggggtaagcactcaaaacaatttggtacctcaaaaagttaaacatacaattaccatataacccaacaatgccactcctaggtatacacccccccccccaccggctgccaattgaaaataggtacccaaactgaaaactgtacacccatgttcacagcagcactattcacaataccaaaaggtagaaacaacccaaatgtccatcaatgaatgaatgggcaatttgtggtatacccacaaaatggaatattatcctgccatgaaaaggaagaaatgacaatacatgctacaatgtggatgaaccttggaaacatgctatgtgaaagaaagcagaccaaaaactcacatattgtataataatatgtaaaatctagaacaggtaaatccatagagacaggttgccagaagctggggaagggagaaatgggagtgactttaatagataatggggtttccttttggaatggtgaaagtgttttggaactagataaatgtggttgcataacattttgactgtgctaagtgccattaaattgttcactttaaaatggttacttttatactgttaaaattaattaaaaatatatatgtatatatgtttatagaacaataaaggatgaaaggctgagcctgaataactgatttacttattcggaaaagcaaagccgtttaaaaaatattttacttctgttgcttctggctataactgaaaatccctcagtccatgtggggaacacagatgacgaatacgcagccctccagcatgtgtatgtggtcattaacttggccttgctggtccagggatttcaggtaaaaatcaggaactatgaaagttattaataactcagttgcttctaagacaggtgaacatctaagacagggccataggaatggtgtaatgcagtcaagagaaaaatgtgaaggagaaggatgcaggcaagttctcctgagagacagatccaggagcataaaattggcattttttctccattaaacaatttgggatgatctgaagtctcctccaagtttctgtctctctctttatcttaattagcaaagaaagtcttaggtacagtaagccctctccttccctaatggattagccagcaaataggaaactaagctttgggagagactaataatagaatgaagggaaagaaggacaaggattgactgtagacttaagctttctccgttcattcattccttcatgttccaaagcaattgcatttcttatttgtatgctacagtcattctccaccctcaaagagtttaccatttattggtgggggtgggggacatggacacaaacaagtatacagtaaaccacagcatcatatgtcagactgtactgtgcatatgaatcctttggcaatcttgttaaaatgcagattctgattcattatgtctggggcagattctgattcattatgtctggggcagggtctgagactgtttttctttctctttttttttttttgggatggagtctcgctctgtcacccaggctggagtgcagtggcgtgatctctgctcactgcaagctccgcctcccgggttcacaccattctcctgcctcagcctccctagtagctgggactacaagtgcccaccaccacgcccagctaattccttttttatttttagtagagatggggtttcaccgtgttagccaggatggtcttgatctcctgacctcgtgatctgcccgccttggcctcccaaagtgctgggattacaggcatgagccaccgtgcctggcctattttttttttttttttaagacagagtcttgctttgtcaccaggctggagtgcagtggcgcaatctcagctcactgcaacctccaacccctgggttgaagcgattctcctgcctcagcctcccaaatggagactccgtatttctaagagcacagaggtgaagcctgtgttcctggtctgaggggctagagtgtgataaccacaataaaaaggagatgccgtacagcagattcagcaaacagcctgcaggccatatcctatttttgtatggcccatgaactaaggatggttatacatttttaaatggttgggaaaaaactcaaaccaaaacaattgaagaaggctgtttcacgacaactgaaaattatataaaattcaactttcagcatctgtaaacaatgtttcattggaacagtcacccctatttgtttgcatattgtctgtgactgctttcccactacaaaggcagagttgagtagttgcaactgagaccatatggcccacgaagcctaacatgtttactatctggcccttcactggaaaaaaaaattgtctatccctggtataaagtaatatgggatttcaagagagagggaaagatcatttccagttgtattcatcagggaagacttcatggaggaagagtatatgagtagcttgaccagtgagtaggatctgagtggcagccgttggggaggaaggaaatctagtaaatgcataggcttggaaataaggaaagcaggtggcatgactacagatctcagtgtcgaaagccttaagccaggttgctgtccagactgccagcttccttctgaatgggaaagagaaatgctctgacacaaagaaactctggttcccagctctggaagattaaaccaattgggcaagtgtatggtggactacatgtgtatccgtgagcaataatgaaggccaggtataacagtggatttctgggtgagcatttggaagccagtggttctcaaagttggggagtgacactcccgcaccctgttccccagggagtgtttggaaacatctcttttgggttgtcatactaattaggggacatctcctgatacttactccccaggagtcaagaatgctaaaggatttacagtgggatgcagaagactatagttctgggcaaggtcacatgtcctcccctgaatgtcaacagcaccctcaataacatgctcagtctgaggactcttctgtggtgtagaatgaccataggttgagaaattaaaagacttggatgaagggaatggaacccacttggatagtgatgaatggagaccaagcaagagggcagattgatgctattgcttggcagtgagaccaaaagacttccatttcccccccaacattcccagagagccagaatgccagggtagagtacaaatccaaagagaatctatattgtagggaatatttatggtgcctatgaaagataagatttgcatgatgggtgaaggtcaatgacaattatttattcacaaccagtcttccagccttaatctgcacagtggttaggtggctagctttgcaatcagaaagagctgggtatgatttcagctttgtctcttcctagctgggaaacctggataagttattttaaattttcttgttttctgatctgcaaaatgggtatggtaatagattgttttaagtattgattgagataatccgtggggcaggcttagcacaatattggggccctcaggggtgccctgtaaatgagtttccatctctctttgcttcaatgaacacgaactgattttctgatgccatcagtgctgctgttggcatcagaatagcaggtgggaaaattagaggggaaccaattttagccatgcatagcattggttgatataagggatggcttctcaatcttggcactgttcatatattgggctggatagttctttgttgtgggggctaccttgtacattgtaggatgtctagtagtatccctggcctctacccactagagacgccagtagcacccccagtcatgacaaccctaactgtctctagacattgccaaatgtcccctgaaaggcaatatggtcctcgatcgagaccactggtttaaggtaagagaaaaataagtcgtggctgtttatctttttatacaaatgtaaggggtacaattgcagttttgtcacatggctatattgtgtagtagtaaaatatgggcttttagtgtaaccatcacccaaataacatacattgtagccatcaggtaatttctcatccctccccctgccacccttctgcgtctccagtgtctataagtccatactctaggtccatgggtacatattattaagcttcacttagacgtgggaacatggggtatttgattttctgatctgtggctgtttggggtgaagggagaaatgcaggattgctttgatttttgtcttagcaaaaaatctgaccataaatctccaagctctatggtctgtaaattcaacaacataccatgttttcccctaatgccaggcactgcattcgatcctggggacagatagaaataagacatggtccctgttctctaggtagggaccacctttttttgcagagccccagctgaggaagaagactcttgaaaactctggccatgaagtggccatttgttttccgggcagagtctgccatcgggtttctaaaaaacgtggttgggcagccacactgataagatgggaggccaggtggatttatgtgggtgtttattctgagagttgggccaaggcacaagctgaaaccgctggcaaaatgaaacttcccctggccactgtgaggaggctgaatttatctcaggggatgtggtttggttgacaagactgattatatggggtttattgtttacatgagtataatatactcagggctcaaggcagaaggtgggttttataaatcagcaggtaagtaaaataaatgcgttgggctagatactcctgctccctggataaaggtgaaaggggatggtgaattacagttaacacagaaaatgaagagaattcaaaaaacccagcggattccttcttaagcgaccatttactgccaccacccaaaggcttcatcccatttaccccacctacccatggccatatattctatgagaacattctgaaattttgtatatacattggaaacagaagcttgtctccttaccattaataaccaaatgtaaggaaatggaaagacggaacacgccctgataaacgtggggcaaagaagggaaacctgacgttgatgaagggctcctctgtagcaggcacagtggcgggtgcttgatacatacatcattccatttaattcacacaaaaatcctgtgggtggttatttcccaaatttgcctgcttataagaaccaccaggcatgcttattataaatccagaggtctttgtccctcccttggacctactgaatcctactgtctggggaaacatgaaaatctgtatttttaaccatcacttcaggggtttctaatgatcggctagattggaaaacacttcattaaactgtaattcatcatccccaagttatatggatgtggaaagtagctttgcctgacccttaattctaaacccttttcatggcttcatggtgcctccttagaaatgacaggtccaattaagacacagacaagatgggtttaaaatttgcctctgctttgcatatcagttccttagagctttgagagtcagtgtggtggagaggacatgaccgctgtaactggagtccaaggactgagttacagctctgtaatttattagctctgtgaccttagacaagttagtaaagctctcctggtcacagttttttcttctgtaaaatggtgattaaaaaaatctcacttgctccgactgcttccagatccattgtgtggaccaaatgagataatcgacgggaaaacgttttgcaaatggtaaagccgcctgtgaggtcttaatattatccattcctgatggagttgataccccaattatctgtgtaaccagtttcttttttgtgcaatacgtaaagctttgaacttttcttctcacttttgggtgacttcagacagcgtggatgatgtgaaaataaggaattcgcgtttattgacagatgaaataaaggatgaaaggtgctctctggcaaaggctgctactaaatgcaagaaaccccgggacaagccacccactgaaggcatgtgcacatgtgttctctgaaactcatgatatgtggcagccagtgctccactggattaacatggataaatgaatattaataggaccaccactctaggaaggataattgggggttgcctagatcactctctagtgactgagactgtcagagaaccttcagactcctaagcctggtcccaccctgcggcaggctgaataaataggtctttaaagatgttcatgttctaatccccagaacctgtgaaaatgttgccttacatggaaaaataactttgcagatgtgattaagttaagggtcttgagaagaagggggagattatcctggattatctaagtgagcacaacataatcacaaggatccttccaagtgaatagtggagcagggagagcacagaagatgtaatgtgggaccagagattggagtgtgatgagtgtgagaaggcgtcaactggccattgctggctttgaagatggattctgccctacagcctccagaaagaatgaagccctaccaacacgttgatcttagctcagtgaaacccactttgggcttctgacctccagaactataagataataaatgtgtgtggttttgagccactacgtttgtggtagtgttagagtagccataggaaaccagtgcacccccaccgttcccagtgtttatcagtggggtgctattgtcatgtgagtggaggctggtttctagcatagcagggcacctagcatctgattaagtactaagtgccagcctcccaaatcatttaactacccaaaacgtgccatgccctggttgaaaggcatagcttacatcgctgacacatctggggactaaaagaacatgtgggaatgggcttcagaggagcagaattttaaaaatacatttaaagcttaatggttctctttagtattaatttgctcactatgagattggaaacttctttatgcctacatgacctctgtacatccggatccaccacctggcccagagttggtgctctcaaagtgattgtgaagaaaataaatggattctttgattatatctcactcctccaaagagaatttataatgccttaaaatattaaaaagtgtaagctgaaaataatgaaatcaaatgccattaaaagaagcagagaaagagatacctagatgcctggggtgggtggtttgtttcttagctccacatttggccttgaattcctgactgcaaaaattagacaggcattacccacttgaacaccttcttaggtctcacatgtgggtcaaaggcaaattgtaggatgttaggagggacatatggtttaccagatatagccatctgaggactctcatgctaaaaatacaaatatatgtttgatctccagaaatatcccttacaattaggctagggatggttgaaaaatacacccagcttgattagagatagccagaggcatgctgctgtgaacggtttattattgagatttttggaggctatgaatgatggggaagatggcatgaagacccagatttgccgtctgtaaatcatttgagactctctctgtgtcatcatcaggactggaagggaagtcccataggctgggagtgggagatgggagggctagagtgtctttgtgtcctctggtaaagaaaacaaacccatctccagccccttgtgtctcctcctacctctgcaaagctgccaggtacaactgctctgtgttattgatgctaatgacccacgtaatggccctgcaagaaggatttcaaatctgcaaatgatggcttttgcaggcaccacaaatcactgagccttgcaatcaaatgcagagggacccagatcactgaaggacttgggataatgaatgataaaatgcagtttaatgtggacaaatgtaaaataatatgtcttggaacaaacaatcagaaggaggaacagctgctaaatgaattggtttgcattacactgaccagggaatagaaatgggcctgagtggcagccaaacaatcaacagaggtgaaggttgaagaggctggtccctgttgtaggaaaataaccccagaaaagtcagagggaggaaaatgatcaagttaattcctgcctcacaggcacctgatacgccacaaagaggaatacaaatggcctgacacccattctgagctcaatgctggctgttgctgcttaagctccttgccagctcctctgctcaacctccaaacctggggtgccccagggattggggggctaacacggtttggctgtgtccccacccaaatctcaccttgaattgtaataatccccatgggtcaagggcagggccaggtggagataattgaatcatgggtcggggggggcgtctgtttcccccatactgttcttgtggtagtgaataagtctcatgagatctgatggttttataaatgggagtaaccctgcacaagctctcttgcttgtcaccgtgtaagacgtgactttgctcctcattcacctgccatgattgtgaggccttcccagctatgtggacctgtgagtcaattaaacctctttcctttataaattacccagttacaggtacatctttattagcagcataagaacagactaatacaggtgccctaggacttgggccttggctttctcttcttcagcctcactatctcaccaaagtatctcaatcagtcctgtggcttttaagaatcatctataccctgaagatactcaaagttacaccttcaattgacctctccctagcttagatctcttagtcagtggtctcaaagttttctatgtattagaatcaccttgaggatattaaaaaaaatcttaatgtctacaccctagatgaatgaagtcaagatctctaggagtgggcccaggcattagttttaactctacaggtaattccaagatgcagttaagtttgagattaagttgcccacttaatctctccacttggatgtatacttagtgtctcaaatgtaatatgaccaaataaacttcattattatccctatttcacacttgatcatctcacacttgatcagtggatggcttccccatccactgatctctcaagccccaaaagtaagcttgatactagttgtttattttctctcactacctacagctactccaccagcaaagtcttcagttccaacttgaaaacatccaacgtcattctaccatcaagtccaacctgtaccactgcaagttttaattaatctgcttacttttggctcttctctactcacttctccctcttgtatccaaagtaatcttaaaaccaggtcatgtcacacccctatttaaaaacctccagtggcttctatcccatgtcgtataaaatccaagctcattgtcctgacttttgaaaccctcaatgactttctacatcttacctttatgatctcattttgtatcattcatcccttatccaccaggctcattcccatgtttgaaattttgcaccatttcatttgtgtaaaatatacttcctttgatcttcacagggctcactgggtcttgtcatttagatgacaccataaaaatgtctccttcttagatcattcttagtcattcaatatcaattagtcatttatcaccatgtagtattttcttgtttgttacctacaagccctcaccagaatgtaaattccacgaaacagggacctagtctattttgttcactgctaaattctcaatgcctaatatagagcctggcacatactaggtgctcaataaatatatgttgaatgaatgaatgaatgaatgaattctatcaatgaaagaaagcaaggcccagagaaactagcttaagattttatagcttatagtggccatgctctatggtttgtaccagtggtttccgggtcaagtttttgtcaatccatagtgaaatgagaacaaagacatcactgtggttctatcaaatagaaacaacttgcttatattttgagattatttacttattgcttttttgatattaaaatgtccttgctcttataaaatgctattgataatatatgacaagttatttgggagtttattttaacttcctcaacaaaataaaaactgtgataacccaataaagtttctagttttctaaaaaagttataattgtggtatccagccttcaagaatactccttaatgattcttgccacctgatattcatgctcctgtgtggttccctctcatgttgcgtagagttgaactgtgaaaccaacaggatattaagtaaatgacagtgtgcgacttccagggccacatcataaaacaccacagcttccttcttatgctcccttggatcacctgctttggggggagatggctgcaatgtcatgtgaacactcaagcagccctatgggaaatgtgtgtggtgaggaactgaggcctccagccatcagccagcactgattcaccacccatatgagtaagccaccttggaagtgaatcttctaccccagtcaagccttcagatgacttctgccttgggtgacatcagactacaacctctcggaagacccctagccagaactacccagctaagccactcccagattcctgaaacagtgaggtaatgttttttaagtcattacattttgggataatgaattatgcagcaatggataactaatacattgattaataacattccaaaaatctggagacctgcattgctgtaatcttttttgaattacggtttgcacgactggctagtttaaccactaaacatctctaagctttagctttcttgtctataacatagaaatagtattcatccctacttcttaggttgctgtgaggattaagtgagatgatgtctgtgtttggaactaatattattgaatgttatttttatcattattcttgttttatattattatggactatttcatgcctaaatgatttgcagtaccatcttctatgcctgaattgtatccctttccccatctgcctgcagaattacactttattccagacctagtacaagtatttatactctttgatgcccttcttgaccttagaagagctgatcctttcctctttgtccctgtattcttttctctattatagcacttatcatgtgtattacaattagttactgacatgtccatctcttctaccatatacaatcctaccaagcacttatttggctgttattacaggccaggtgttgtcctaacacttgtatatattgactcatgtaattgttacaataaccctaagaggcaagttctatttttatctctattttatataaggggtaacggaggcacagatttaagcacgcagtagagccaagattaaaacctgggcgtttcagctcccaatgtggtgctctcaaccatatcatccctcagagaaagggagcaccctatggacagagaccttggctcacttatgttggcctccctagtacccactagagtttttggaatatgggaagcttgtaataaaaataacagcaattattatctgctatataaaatactatgctgagaactttacaaagcagagattttaaaaatggccatttacaaatgagaatcctaaggcttagcgaggctaaataacttcatgtaaagctcctagaggtggcatagcagtcaggattccagcccagggccatttgattccaagggccattcttttttcatggcatcaaacacgcccaatgattttgaatgaatgaatgattacatgaatatgtgatggaatatcatttgtcataaattggcaaaggagaaagtgaatgatccgtgtgtacttatttctactttgagataaatataatttgaaataataatggggttattgagatataaggaaatgatgccacagaaggaagaacattgattttgtgctggacagctttctattttatgtggcctgctgattgccagtgacaatttccagtatagagactgacatcctttacaatttgagctgtccccagcctccatgtgccctgtggtgcaggcaacatgccttttctttctcttttttccctccctttcttccttcctttagcattttaaaatttatttatatttttaactgacaaatgaaaattcaatatgtttattgtgtgcaatgtgataatgttttgaaatatgtatacattgtggattgactaaatctggctaattaacatatgcattactttgtatacttgtttgtggtgagaacacttaaaatctactcttaccgatttttttttttttgagatggagtctcactctttcagccaggctggagtgcagtggcatgatcttggctcactgcaaccaccacctcccaggttcaagtgattctcctgcctcagtctcccaagtagctgggattacaggaacacaccaacacacccagctaatttttgtatttttagtagacatggggttttaccatgttggccaggctgatcttgaactcctgacctcaggtgatccgcctgccttggcctcccaaagtgctgggattacaggcgtgagccaccatgcctcggcccctctcttagcaatttttaataccacaatacattgctattaactatagtcatcatgtacagtagggctattgaaattattctaactacaattttgtatattttgactgacatctctctaatcccccaaccttcctccagcctctggtagccaacattcttctcttcacttctatgagtttaactttttaagattccatgtgtgatatggtttggctatgtccccacccaaatctcatcttgaattatcgctcccctattccccatgtgtcatgggagaggcctggtgggaggtaatcgaatcatggggatgggtattcccatgctgttcttgtgatagtgaataagtctcatgagatctgatggttttacaaagggcagttcccctgcacatgctctcttgcctgctgccatgtaagacatgcctttgcttctctttcaccttctaccatgattgtgaggccttcccagccatatggaactgtgagtctattaaacctctttttctttataaattacccagtcttgggtatttcttcatagcagtatgaaaatggactaatacaacatgtaagtgagatcttgtggtatttgtgcctggcttatttcacttagcatgtcttccagattcatctaggttgtctcaaatgacagaatttccttcctttttttttaaggctgagtagtattccattgtgtatatccactacattttctttaccattgctccactgatggacacttaggttaatttcatatcttagctattagaaataatgctgcaacaaatatgggatgcagatatcatttcaatatactgattccatatcctttgggcatatatacagtacagggattcctggatcatatggtggttttacttttttgaagaatcttcatactgtttccgtaatggctgtgctaatttgcattcccatcaacagtgtttcagggttcccttttcttcacatcctttgcacatattctccaacacttgttatgtttcatctttttgataatagatattctaagttgtgaggtaatatctcactgtgattttcatttgcatttgatgattagggatgttgaacattttttcatatacctattggtcatcggtatgtcattttgagaactgtctgttccaatcctttgcccatttttaaatcaggtgtttttactactattgagttgcttgagctcctatacattttggatatcaacttcttatcaggtgtatgctttacaaatattaatactttccttctgtaggttgtctctacactctgttgataatttccttggctgcataaaaggttttcagtttgatgtagtcccatttgcttttgttgcttgtgcttttgtgttcatatataaaaaaaatcattgcctaaactaatgtcatagaccaatgttgccttatgttttcttctagtagtttcatagtttcaggtcttacatttaagtctttaatccacttttagttggctattgtggtgcatggtgtgagttaagggtctaatttcattcttttacatgtgactatccagttttcccaacaccatttattgaagagactgtcctttccccagtgtgtgttcttgacacctttgtcacccttgctatcatattggcctgagtcactttcagatgttgctgagaaaaaaatcccaacccatgggatacttaaaacatggctcttaaaacttgatctaaaagtgctttagctaattgagatgtattgtgattccatatgaattttaggaattttttctatttctatgaacaatgtcattggtattttgatagggattgcttgaatcagtagaccattctgggtagttcagatgtttaacaatattaattcttccagctcatgagcatgggatatctcactacagttttttgttcctcttcaatttcttttcttagtgttttataggtttccttgtagatagcttttacttctttggttaatttattcttagggttttttttttttttttggtagctattgtaaatgggattgatttcttgattcctttttcagattgatcactgttaacatatagtaatgctacagtttgttttctatctacctacctatctacctatccatcctatctatctatctatctatctatctatctatctatctatctatctatctatctatctattttaccatttaccatgggaatgataggtttttttaaaacctaagattatctcatttgcagacaaggataatttgatttcttcctttccaacttggataatcattttctttctttctcttgcttaattgctcatgaccactccagtactatgttgcataaatgcagtgaaagtgaacatccttgtcttgttccagctctcatttctgtttatcaatgaatagtatttcattgtgtagatgcaccatggttaatccattaattattggcctattgaagggcatgttggtgtttctaagttttcacaattatgaataaagctcctataaatatttgtatgcaggttttcatgtggaaataagttttttattaatttaaatgaacaccaaggagtgttattatgaattgaccagtttcaactggccgtgactggctttgactggttttgagcagccatcactggttttggctgtccacgaccagcttcaacttgtttccactggttttgaatggtcttggctggtgttggccggtttcaacaggtcttagtcagttggtttcagccagtttcagccagtttcatttggttttgactggtttcaactagcttctgcgaatttccatgggttataacagatttttactagttatagccaatttggactagtttcagccaatttggactagtttcagcagggctcaactggttccagctggttttgactggttttagccagcttcagccaatgttgactggtttcattcagctttgaccagtttcagttggcttcagccatctgttttgactagtttcagctggcttcaactggtttaaagcagtggtagccagttttagctggttttggctggtttagaacagtttagactcctctgggtaattatatctttttctctttaaaaaaaaataattttaacatttttgacttggggttatatgtgcaggttacctgggtatattgcatgatgctgagtttggggtatgattgttcccatcaccaaggtactgagcatagcacccaatagtttttcagcttttcaccccctatccacccccgaccatctagcagtccccagtgtttgtgtttgtcatctttatgtccatgagtacccaatgtttacctcctatttataagtgagaacatgcagtatttggttttctgtttctacattaatttgcttaggataatggcctccagctgcatccatattcctgcaaaaatcatgatttcattctttttttatttctgtgtagcatttcatggtgtatatgtaccatattttctttatttgattcactgctaatggggggcccctaggttgatccacgtctttgttattgtaaatactaatgtgatgaatagaggagtgcatgtgtctttttggtagaacaatttattttcttttggatatataccccataatgggattgtgaggttgaatggtagttctgttctaagttctttaagaaattcacccccggctggacacagtggctcacacctgtaattccagcactttgggagactaaggtgagtggatcacctgaggttgagagttcgagaccagcctgaccaacatggagaaatcctgtctctactgaaaatacaaaattagctaggcgtggtggtgcatgcctgcaatcctggctacttgggaggctgaggcaggagaatcgcttgaacccgggaggcagaggttgcagtgagctgagatcatgccattgcactccagcctgggcaacaagagcgaaactccgtctcggaaaaaaaaaaaaaagaaatctccaaattgctttccaagtggcagaactaatttacattcccaccaataatgtataagtgtttcctttttctccacagcttgccagtatctgttgttttttgactttttaataatagccattctgacttgtgtgagatggtatctctttgtggttttgatttgcattcctctgatgattagtgatgtggaacattttgttgttgttgttcacttgtatattttcttttgagaagtggctgttcatgtcttttgcacactttttaatggggtttttttttttttttgcttcttcggttgttaaaatttcttgtaggttctggatatcagagctttgttggatgcatagtttgtgaatattttctctaattctgtgggtggtctgtttactctgttgatagcttcttttgctgtgtagaagatctttagtttaattcggtcccacttgtcaatttttgtttttgttgcaattgcttttgaggacttattcataaactatatcccaaggctaacatccagaatggtgtttcctaggttttcttctgggattcttgcagtttgaggtcttacatttacatcattaatatatcttgagtgagttgacttttgtataggtgaaaggtaggggtccagtttcattcttccgcatatggctagctggcttttccagcaccatttattgaataggaagtccttttctcattgcttatttattcccactttgttgcatatcagttagccatgggtgtatggcttatttctaagttctctattctgtcccattgttctatgtgtctgtttttgtaccagtaccatactgttttggttactgtggccttatagcatagtttgaagttgggtaatatgattcctccagctttgttctttttgcttaggattgctttggctactcatgttcttttttggttccatatgaattttagaatagttttttctatttttgtgaaaaatgatggtagcttgataagaatagcattgaatctacagattgctttgggcagtatggccattttaacaatattgattcttccaatccatgagcatggaatatttttccatttgtttcctgtatgatttctttcacagtttttgttttgttttgtttttgtttttgtaattctccttgtagagatctttctcctctttggttagatgtattactatatatgtgggtgtttgtgtgtggctattgtaagagggattgtgttcttgatttgactctcagcttgaatgttatcggtgtatagaaatgctatatttttgtacattgattttgtatcctgaaacctcactgaagtcatttatcagtgccaggagctttttgacagagtccttagggttttctaggtatcatatcatcagcaaagagagatagtttgactccttcttttcctatttggatgccttttatttctttttcttgccagattgctctggcaaggacttccagtactgtgttgaatagaagtagtgagaatgagcatccttcactttttccagttgtcaaagggaatgcttccagcttttgcctattcagtataatgttggctgtggttttgtcatagatggctcctattattttgaggtatgtttctttgatgtcttgtttcttgagggtttttatcacttagggatgttggattttattaaaatctttttctatatctattgagatgatcatatggtttttgtttttaattctgtttatgtggtgaatcacatctattgattcatatatattgaaccaaccttgcatcccaggaaggaagcctatttgatcatggtgaattaactttttaatgtgctgctggatttggtttgctagtatttcgttgcagatttttacatctatgttcatcagggatattgacctttagttttcttttttgttgttgtatctttgccagggtttggtgtcagggtgatgctggctttgtagaaagagttagggaggagtcccgcctccttgattttttggaatagtttcaatagagttggtaccagctatcctttgtttatatggtagaatttggctgtgaatccacctgatttggcctttttttggttataggttttaaattactgattcaattttggaacttaatattggtctgttcagggtttccgtttaatcttgggaggttgcgtgttttcagaaatttatgtatttctgtgggattgttgtaatgttaccttcgcagtttctgattgtgcttacttggatcttctctcttttcctttggtaatctagctagtggtctattgatttttatcttttcaaaaagccaccttctagattttttgattctttgtatggatttttgggttgccaatttcattcagttctgctcaattttagttatttcttctcttttgctagctttgaggttagttcgttcttgtttttctagttcctctaggtgtgatgttagattgttaatctgagatctttctatgtttttgaggctggtgtttagcactataaactgtccccttaacataacttttgctgtatcccacagattttggcatgttctgtctctgtgtttatttatttcaatgaattgttggacctcttggatagaaccacaaaagcataggcagcaaaaaacaaacatatagttgcatcaaactaaaacgagtttgatgcaactgtattcttctgcacagcaaagaaaacaatagagtgaagagacatcccatagattgatatgtatatacatctgtgtctatgtgttttggctttgggaaatcagtaaaccacaggactttgattttaatttatgtacacaggtaggtatctcccaggggcctcttaagaggtaataatgcaacgtaatgaaaaaaaaaaaaagcaccgtgttagagctgaactgtactagtaccatcacctatgtactatctccatgtgggcaaattacttaaactctctgtacctttgccttcctatcagtaaaatgggaacagtaacatgtattttagcttcatggtgaggattaaacataaagctctacctgacttgggcttcccattcatctctgagcttatagcctaagatactccccctacagcacatttctttccagctaccttagtttcttagtcattcctcaaattcactgggcaagtgcctgcctcagggcctttgtaccagctcttccctttgctcaaacattttcttctcagatccccaaatggctcaccacatcaagtcttggctctcatgtcccctcctccatgaggcttgtcctgactcttctgattagttctgtatcctcctcctgccactctcaagaccctttgctttgctttctcttctttccatagcagttaacatctccttgtagatgagacgttgtatttattaattagtatctatctccaactgctagaatgtaagccatatgagggccagggtcttcgtgttttacactggtttatccccagcaactagaacacagcctggcacatagaaggcaccccataaatattcactgaatgaataaacaaatgaatgcatgaatgaaatcactcagtacagtgcctggcatattgtacacatctaaggaatgtagctattattgttgttacctggatttccccaggatacttcatcctggaactgtgaataattttaatgcccaatttcactacttgccaaacctgcacatctgcaggtgtcaccctcctttttgactactaccctgatgtctcctccagtcatttataattggggcccaggtggccatctgattttgttctttagctctggacttgtggtggcatcatgtacttgaagtcctatgggggtggcccctctctgtccagcagctgctgccctctgtgggatgctgctttcctgcctccctgctgggtcctgctgcttcctcatcaccttgccagacacagcagatgctgctgctgctactgttgctgcttcccatcctttctgattgctgtcgctatgttctccctagaaactcagaaaatgctctgctccctcaccttccgtctggctggctcatctggaccctgaagtgaagcagcgtgtgctccaagcctttcaaggtcactggacgaaacaagtcttcttcagttttcacttaggaccagtatctgacaaagagatgccatcgtgcccttaatgttcttgtctcccttctgtttttcttcctgctttactgaggtataattgatagaaggcaattgtatatatttaaggtatacagaatgactttttaatatttgtagacattgtgaaataatcagtcaaattaattaacatatccatcacctcacatagttaccttttctcttttttctttgataggaacacttaagatctaccctcatacaaatttcaaatacacaatacggtattgttaactgttgtcacttatagtgcattaaatctccagaatttattaattttgtatactgatactgtaccctttgcccagatctcctcatttgcctctccttccaacccctggtaaccaccacctactctctgcttctgtgagcttgactattttagattccatatataagacatcacatagtatttgcttttctgtgcctggcttatatcacttagcctaatgtcttccaggttcatccatgttgcaaatggcaggatttcctttgtttttaaggctggatgatattccattttcattacccattcatctgttcatgaacattatgttgtttctatatattggttattatgaataaggctgcagtgaacacgagagtgccaatatctgttcaggataaaaattttatttcctgggccgagtgtggtgactcacgcctgtaatcccagcactttgggaggccaaggtgggtggatcacctgaggtcaggtgtttgagaccagcctgggcaacatggtgaaaccccgtctctactaaaaatacaaaaaaattacccaggtatggtggcgggcacttgtaatcccagctacttgggaggctgaggcaggagaatcgcttgaacccaggaggtggaccttgcagtgagccgagatcatgccattgcatgccagcctgggtgacaagagcgaaactccatctcaaaaaaaaaaaaaaaattatttcctttgggtatatacccagaagtggggttgctggatagtaaggtggtttgaggagtctccatagtgctttctagctttctttgaactaacctcctccccttcttgcaaccggagacacacacagcccccaggcctactaattcctgcaaatgcttgtctgccagcaggtggctactggtccctcatgttcagtttttgcttagcttcagcgaagacatccctcgagagcataagaaaaaacagtcatcatttttaaaaatacagaaaaaatctattgctttattgcatgttggtagactgctgttccctttgacagtccagttctgcatgacaagtctacttgcatgtcccgacagatggcccatggtaacggggcattgctgatcttgttacaatgaaatctattcaatgaaaaattctccccagcagatgtgtataccagcttcatccccatgtgggtatcaatctctttatgagacattgttttggtggtatttataagcagacagttgtaggataaagagagagaggtgactgctattagtattaattatgatctcttgcatttagtgcttcatgctttttcaaaaatgtttccacagctgttcctttatttgattcttgcaacatccccatggggtagacatcagagatgaagggagaaggcatgcaaagtactttccttccttcctttcaagatgttagaataagtttgcaccatggttgtggccatcaggtggtaggctgcacgatgctgcagagagaactagactgggaatcccagctctgcctttgaaataggagagcatccttggagaactggtgaatgtcccggtcagtgaagtagtcttagccgggttgctgcagtggccgcctaacaggtctcactgctgtctttgtcttgcttccatctgtcctcagtgcagcagccagaggggatgttttaagtcatacttcagataatatcgctgcactgctcacagaccctcccaaagctctccaccccactcagagcaagagcagaatcctggcaatggctgacaagacccctgggttttgtccgacatcttctctggccccttctcccacctccgtttgctcatgctctggccacattggcctccttggtgctccttgaacatggcacagttccatgggcctccacggcacctgcttcctctgctgccacattgttccccacctgtgcttggctcaccccctcatggccttccatctgctcgtctcaccttcacgtctccgtgaagcctgtcccaatgactgtatgcttcccttgcctgcctaacctctccttcctaatccttctcacctgttctctggattgcttttcacgacagcacttaccgtcgcctaacattccgtaagtggtcacgttcctgggctgtcggaacaccacaaactgagggacatagatggagctggaagccattatccttagcaaactaacacaggaacagaaaaccaaacactgtatgttctcactcataagtgggagctgaacaatgagaacacatggacacagggagggaaaccacacaccccggggcctatgggggtaggagtggagggagcagggagggagagcatcaggattaatagctaatacatgtggggcttaatacctaggtgatggatggataggtgcagcaaatcaccatggcacacgtatacctatgaaacaaccctgtatgccctgcacatgtatcccagaacttaaaatttaaaaaaacaatttttttttcaaaagtctgatatcaaggtgctggcagggttggttccttctggaggctgggaaggggatctgtgctatgctctctcccaggttcttgtggttgctggcaatccttggtgttcctcggcgggcggcaccatcactccggcctctgcctctgttttcacatggttgtcttctgtctgtgtcccaatttccctcttctcataaggacaccagttgttggatcagggcccaccttaattcagtatgacttagtcttaacttgattaagtacatctgcaaagaccctggctccaaataaggtcacgttcagaggttctgggggttaggactgcaacatagctttttggagactcagttcaacccataacactctcatttatttatttattttttttatgtttcttgtttgtttacctctgctcaataaattctgcgaagattggggcctttaatatatgagctggtaggatcccatgatactcacaaatgtcagcttccttccctcaagttcttaatccttttaaatattatttatatccccaaatgaaagtctcataatagttaactctcaattattcacccatgtttggtaacaggccaagaaaacaatttcacagtcatttgtaatgtattgccagaaaaatcctattttgacaaattagacattctatcaaactttctagcttgcattcacattccatttacctagaggctgccacagttctacaaaaggttttacgactagagacagagttctgagacacattgtctccactcagaacctctttctgtggaccttgtagtcaccatgtgtacctccggccaccccatcctgccctgggtcttgtcctcaggttggcaccttacccagatgtcacaaatgcttctcagaacctgccaaccagactacagaatcagacccctaccatgtgagagtcagaagggatcctaaaaatcattcatttgttcactttacaatatatttcttgagtcagaagggatcctaaaaatcattcatttgttcactttacaatatatttcttgagcacctattatgtgccaggcattgtgagtttcctattctattccctttgaacctcacagcactgtgcaagatagatattatggtctctgcattccagatgagagcacagaggcccagagcagttgggagacttgctgtgactactcagctagctggcggtagacccagattcagatccagcattgcctggatctggagccctttatatgaccttgccttgaactactgggcctctgcttttcaatcactctcatccttggtggcacacaagatagccaatagaaggctggtgacaggtcattcttattctcaggcttgtagaaaattttgtatactagttgacattttctcttttacagagaatctttacctttataaatcactttcatgaaggcagaggaggtgctgtgtgatggtggcttccacctggaccccagactccctctccgcctttctctgcctggggagacccactgtgtgcatggcactcactgactcccatacctctggctatcaaaggtttctgccatggccaccctggaaggaaaccagagggaggtagacagggagatcaggtcccttctactctggttcctgctctgtgaaattgtctcaggctggctgtgtccagagggtccctggttctctcagggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagaggaatgtccaattggcctgagataagcctctggtaaaatgtactgtacataataggtaatcaataaatgttggctgatgacaaacatgttttctttgttcattagttatagtgattatgttctaaataactccaacaaggaagtcagcacatttggaatatcattatctttccatgataatatctttccatggaaagataatgatattccaaactgggagtgtccctagcagatctgagtctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcagggtcctcccttaatgaggtgtgcgatgtacaagagtcgtgaggtggcaaaggatgggctcctgaggaaacacttaggaaactgggctttctgccattaaaagagacaaacctttgtggtgacctaattaaagtttttaaaattcaatttggaaagttagcaagctaggctcctttccaggaaaaataaggagtcagtgcatgacctaaccggtcccgggctgcttgccattccaaacaactgcagtaagtttatcaccttctttcagggactgaggtttccaggcacagacttggataagaaggatgtcctatggggtcacattgatgctgtggcccaagagaggttgccatgactcgagaaaggttatgaagtatggttttcactaaaggaaaactgatctctttcgattgtttctatggaagcttgtggattataaaacagtatcctttcaaatccatccatccatgtactaacccatctatccgtccatccattcatccatccatcaatgcatgcatgcatctatcattcattcattcatccatccatctatccacctattcttccggccatttatttatccatccaacatatactgagttgctactcccaccaaacactggagattctatactaaatatgacataaccaatactttgaaagagcccaggcttcatgtaaaagcacacaattgaaacaatggttacaagcacaaggcgttaagtcaaaagaccttggtttgagagttgactttgtaatttaagtggccctgtggtcttgggcaagtgtttctctctaggccacatttttcatccgtaaaataatgtagctgaactcaaggaatgctctctaagatctcttcatggtcagatatgctaagattctctgtccaggcaaattcagggcaagatgagatcatcatgtgagtgcagacagtgcaataatctagtcagtggtctcctctgtccaccttgcccatccactctatcttctacagtgtaggcagagtcatcttttcaaaagaaaatctatcacagctgggtgtgatggctcacgcctgtaatcccagcactttgggaggcgacagtggtggatcacctaaggtcaggagttcaagaccagcctggccaacatggcaaaaccccatctctgctaaaaatacaaaaattagccgggtgtgatggcatgcacctgtaatcccagctatcagggaggctgaggcaggagaatcgcttgaagctgggaggtggaggtggaggttgcagtgagccaggatcacgccattccactccagcctgggtgacagagcgactctgtctaaaaaaaaaaaaaagaaaaagaaaaaagaaaagaaaatctatcacatcttttttttcattcatccctgcagtggtggattctattcctcttcggctaaagatcaacattcttaaggaaggtcttcgcagctcttcccagttctccagctcattttgtattaagccttgacttgctatctttgctccttaaacttgctatgttccctcttattacaaggcttccgtgtggcccacttgtacctttccccatcttctatcctgggagaactgctcatccttcagatagcagcctactcaccatttcttcagggacactttctctcacctcccaggtgaggcctggcttctatatatacacatagatcaatgtttcttccttttagagcacaaaccccaaccctgaaccatagcagaggggatccttagtttaacatctggctgccccaccagcttaccaccctcttgggagaaggaactgggtctagtttgctcactactgcactccctaaaacagtgcttggcacatacagggcccccagcaagcattcgtctgaacaaacatggagaatatggtgagtgccctaggctgacaaatataaattcctcatacccggagatgaggacaggaaatagcatccttattggggtaattcacttgaaaaaaaaaatgcctcaaaagaaatccacccatatgttgtaaactcactgctcataagagcaaggtgctctctaaaccccatcaggtagcccacagtgtctctcaaaccttaagggggaggacccttttgaaccaaaatggatgcaacaatagctgtgaagccactgctgagctgctgacggagggtagaggtgacaggtagagatggaaaaaacaaaaggccagagagacagaatttgaccaggggtctctgccactgtgcaaggtaggggtagtttttttcagtctagaatattggttaagtagttgaaaaagccctagaggaaaaagaacaatccataattgttcctgagtgtggttaaaaagcattttgagtaggaatctgtgtagcgcagtggttgagggaatgtcagacaggtctggttgaagtcatagttccagcaccgagtagctgcgcagtgctgggcaaatcactttgctctgagcctcaatttccttatttatggggataatggtatgtttaccattgggctgttggaagaagaaacggaggatgtaagctcatgcttaacacaaggcctggcctacactcagtgctcttaagtgaaagctgttgtcagtgagatgaattactttgtcataattctctgctcacctaactgtccatctggtctgcatttgattcctgagtaaagccatttgccagaaatgagctctcatggaaactgtacatttctgtggctctaaaccttgactcctctctttttctccatagcataccaagtctagcagtaatttgtgttggctctcctttcaaaatgcatgcagaatccagttgcttctctctccttttgctgccactgccctggttcaagctatcagcatctctttcccagaggactgtagtggcctcctaataggcctgcctgccggggcctttgccccctatggtcttctcttggctaacagccagaaaaaacctgctaaaagctaaatcagatcataccactcccctgcttgaagatgtctgatggccccatcacacttagaagaaaatccatatccagatccagtcccccaaaaccttcaggattccacattagccaacttttttgatcctatgcactctctcctaacacataggttccagctacagtggtcttgccacacaccaggcacactcctgcctgagggccggaaacctctctacctagaaacttgcaagctggcctttccatctcctttaggtctttgttcatatgtcacattctagctgaggccttccctgactgccttatttaacactgcaatccccaccccacactggacgccttttcctataactcatcccctactttattttacccacagcgcttgtcactatttgatccttatatattttacatatttgtctattatctgtctctcccactaagttccattacaaaagagtttttgttctttttttgttccctgttgttcctcggtgcctagattctcatagaagcaatgtgctaggtgcttaataaatatttatcatgtgaatgaatggtcagcccacttcttggggtgaagccttatgtgtatgctcagaaactgtcctggcttataaggttagtgtgggccaggctccccgagcattctttttatagagattctgctaaaatcaaatttctgaatcctctggactgcagagtcagtctggcaccttagatgtccctgatacccagcctaagctttaggcactgtgacacatacttttaaaggtggagaatgagtcagaatctgataaggtataaatatttggttactcacctcctgaaggtgaattagctctcacaggttgccagaaatatctctcggttccctgaagctgaaacacacttgctgatgtgcattaatagccaaaatggtaggaaatggcagagtctgccattattcatccacttaccaggggaggaaagaagataaatttattgtatatgaatgaattaacacaggcattgtgcctgttgagcaggtgtgcagggaaggaaagtggatgaatatgtgtgtgtgtgtgtgtgtgtgtgtgtgtgtgtttctcatgttcctatccttaatcaagaaaatggaatcccttctggaagacctcatgaccacatttgaagctctaccatttttctgttttggagaatagtggtttgggttttatagaaaaactggaggcagctctgagtaagagaaacatggtggtggtgatttcccagaactcatcgggcttctccaagttgggacacatgttggtcaaaggatgagctgctggcaattcatgatgaagacactggagtggataagacactcatggagacacttaaagcaggacaccaacctaggaaggatctggaagtagaagtgagtggaagatggcactaaaagtggaagaaaatcatgaaagacgtgatctgtccttgctgcttcagtgattacaagtgggctccagcagtccttccaatcagattctattattgaagaccagtgtattatttaaatgcttctctcaggagcttcgaaaggaggcagagcgaatagagagggaaagaaaagagctctcatgcctccactgtggcttggcactgggtgggtagggcacaggtgctggatggcaaagcattggcttgctgctctgatggccatgctgatgggacacagggaaggagaggcactgaacacttagactttcacagaattttcaatatcaatatgcaacttgtgataggttgtagttaaataaatttgttgttgtttattaaaactttttgcatcctcatgttgaggaactcaaagtagaaaataatgtctgtagagaaagtatacttttccccaggtgtgctgagtggcagctcttatccagtgacgtatactatcaaaaataccaacttggactctgtgatggttaatgttgagtgtcaacttgattgcatggaaggatgcaaagtatttttcctgggcatggctgtgagggtgttgccaaaggagattaacatttgagccagtgggagaaggagacccaccctcaatatgagtgggctccatctaatcagctgccagtgcaggtagaataaagcaggcagaagaacgtggaaggactagacttgctgagtcttccgatcctcatccttctcctgggctagatgcttcctgcccttgaacggcagactccaagttcttcagcttttggactcttggacctataccagtggtttgccaggggcccttgggccttcagccacagactgaaagctgcactctgtcatcttcccaacttctgagatttggggactgggactggcttccctgctcctcaggttgcagacggtctattgtgggacttcaccttgtgattgtgtgagtcagtactccttaataaactctccttcatatatacacctatcctattagttctgtcccttcagagaaccctgactaatacagattctgagggcagaaactcattcattcatctattcattcatatatccatctattcatttacttgctcatctagcaaatatattttgagcacttactatgtatcgggcagatgtcctgatacagaagtcaacaagatgaacaaatccctctcttgaagcttgaattacagtggggaagacaataaataaaaaatagaaaagataacttcagagagtgaagagtactgtagagataataaaatcagtgagtgatgtagagagctctgggggcttagagttcaggctacttcagataagatgattagggaatgcttctctgggaagggatcttggtgctgagacctgaacaatgggaggacccagccacatgaagatttaaagtgatgactcacaacctttgaagtgcattcatatcacctgggagtttttaaaaatagatggtggaccccacctccagaggtggaaatttaattgacctcaaggtaaggcttaaaattattctaatgtgcagccagggttgcaaagcaacctagactagaagtggaacttactagacagaatagcatatgcaaatgtcctcaggtagggaatggcttggagtgttccccaggcagaaagaaggtaggtatgactgaattagatggaggtaagaaacaaatttggggagggagtcagggattatattcgcttaggtgagctggtgagcatgtcacagatctagagctgggccccacagtacacagaagtacacagaaaacaagagctccttgctgcgtgcagtggcattgtcttgtgaggagccagggagttggaatgggtggtagggagaaaccccatacatttcacttcttcagtgtcatcacacagcaaactaatctgaactgcagaatttctctggtgatcagctgcctgttttcctggggtgatccatctatgaaaagtttccaaattgtgttaaaactgccagtttctcgacaaacagcacggagtgtactttccagggagaaaagttcaataattaaaatgagtcagcactgaagaactggagggcggtttgatctagtttagcagccgacgttttcttagcagaaaaatgcaatatccataatacataattttgtgctgaacagaagtcaactagaacagaattgtctcaggagggaccaaagtcagcttgccagaaaatctttttgaaggcagcagaaaacctggtcttcaaaagctgaagttggggagtggctgaggggccatgtctcaggtgcctacaggctggaggagctccctgagctgttttgacagggactcccctcttgctctctccagagcaattttaaagggcagataaacacaacacccaggttgtctgaacacctggagttcagaagcctgacttctcaccaccagcagaaagacctacttaatattgggcagctcttattctagggactaagtttgcctttgcctggggtgttaccacaggaggtgggagtttgggggtaattttttgtttttctgagaaaagaagagtgattaaaggagaaaatcatttcctctgggtggtaagggtccctgcaaaacatcccccgactgagcttccaggaagagtgaaaactgccaaacctgaaagtggtttggcttggagtctaagtccccaccagaggttgcaagtcctccctgtgcctgcagcacagtctcttcctggggctggctccgcgatttcaaaaacatagacaaattggctctcttctggcctcctgaagttcatgcaatcatgggaccaactaaatttgtgttagattatgccaaagactgaacaacattttgctttttttttttttttttttttttgcttcactgacaatagtccaagagaggaagccttcaattagagtagcagaaaatgctgattagaatcaatcaacacctctagaagtttaaacacttaagttaattaaatggttcagtaaacttgaagcgaaacttgcaaacagaaaacgcgacgtataaaaggatgcttagatttttaaaaaacagataattatccaacaagctcaacatcaacctcaccaaaggctctgtgaaaatgattaggcaggcagcgcattaattttcaatgcaactcacacttaggttcatatcactactcaaaagcaaaaactcatgactcctatcagcgggtgtgttgttctggtttcgagatatactattaggaaactggcaatgcacctgttgtattttagtagtcctgaatattttaagagatcactgtttccttaccctcagtacaaacaaaatcctgcaaagacagatctttcctgcaaagcaaaatcttgctggttttgtttaattttaggagaaggcccaatctgaatgagtgaaaacatgaaacacagattttttttcagacactaaaaatttgtaactcttctgctgcaaaataaagtcaaactagatgtcttctgttgggttcctttagacacagcctgcgatggagagtctagttcaagtgttttcctgaggatatggtccccagaaaaggggaaggaggaaagcgggacagagctgaaacaaatatctaagcaaagcttttgatttgcctgcagattgtttcagtctgagcccataggagggcgctggagtatgaatctcacaacaaaattagttccacctgagacaagaagatcagcctctgatgccccttggcatgtatctattagtcatgggccgtgggcttctgctgggggtgaggtgggaatgtggtagcctgttgagcagttagcagagggcagtcccccaggaaaagcggtggctgtgaggtgtaatcagacaaagtcacagctgctgggggagaggggcagcggctaccgatgggatctgggcaggaggtctacatgactggaccaaggaacttctgcctcatagagattgttgagtgatcttaggcaagacaaaagttgtctttgataaacaagcctattctaaagtgagagctaccccaggctccagacactatcttgttcacctctgaacataatgggtcatcaacaaatgtgtgttaagtgaatagcaaacagatcacttgcagtgtccactgaatatgatgcagcttccatgccctttctacgcatttcacaaacacccactgaagatgaagcaataacttgctacttgaggttcagtcccatcagaagacatgggttgagcccttgtgtagtttttcattagtaatgatgccttgtacctcagttgtccaatctttaaaatagggaaaaatcacaacatgacagggcttttgtgaggattaggagaaatagcacatgaatatacttagtaatttagctttttctcataaaatgtttttctttggaaaaatttcagaaaagctgaagtgcaggaatagagacatttaaagctaaaggattagaagcctctgataataaaaatttgctctgtaaagataaagcaatactagaactgtgctgtaaagtcaataggcaccggggattgatattgatctacagaatacacttgtaggaatgaagctactccataaagccaggcacattgagaatgagcatctcattgttttatctcccaatatagtgtgcaggtcaggctctgaactcttcttaactagaaagatagtgagttgcaaataaaacaggtgttggccattaatgaggtctctacgcacaacacttactatactacctctcagactatgtggagtggtttcttcttttgggggtttgccaaaaacaaagtaacattgcctacgaccttccttccataaaggcaggaggagggtgagtgtctttgtctgcacaggacacacagctgcaagaactctgtgacttggtgttcccactgtctgattatctgttgtgtcctccacagatcctcttttcttgcccctgctgggaagctatctctggttctagagcagaaggccatcacagaaactcagccaaacagtaaattggaggtgaggttttcaccaggaccatgaagacttcacttcttcaatcgggtaacttcccaaagaagtattttcctactttagagatgtggaaggattgggagctgctactcaagatgatcttacacatgcactgaatggtttgagcatcattcttatcattgattaaggggctggatcaacggctggacttcaggcatggtcagaaggaaaaaggagcctataattggccatttcttggctgggtcatgaccacagcaagggcatagatgtttaataggcagtgtaaggttacaattccaaatatgcattaactgaacccatcaatgatatctagcggggacaacgggaggacttgaggacaattgatgatggtaagtcatttgacaaaaatagggcctgaaaaaatacaaattttggttctatatcttttgaaaaatatcactccttagttgtcacttaagcctaggaccaaaggctagctagcttccctaatcactaggcttacttactagagcaaagggtagagtgtgggtacaggcatctgttgttatcttgcccagcatatatttatttatccctcttcccttggtaacagcacccttcctttcctttgaataactgtgcctactgcatttccatatggccctggggggcaccaatcctggtaccctgttcctgggtaggttcatgaccttacaggttggccagactcagtctcccaggaatctgaattataggtggagtgaaatatgaatggaaggtgaatgaagacaagtcaatttgatggcagttctcagaaagaatgaatcggagatccctggtactgacctgatgttcctgaccttcttgtggtccttgattctatgagttacttagtgttctctcaaataaactaatccttaaattaactagagtggcttttccgtttcttatagtcaaagaacactgagtgctccctgccatggtgcccctaaggagagaaaggccagtctctctttcttttgctctgtctgtatatgtgtgcatttgtgctggtataagcactgacaccagttcctgaggcctccataaaaggtacttcaggccccttttcaatttgagaggcagggtgtgatattattatatgttaccatccatctctttcttaaagaggcaaagtctcataggggaacaagcatagattttgcaatccagaaaaaattgagtttgactgaaaaaactgagttccgtcatttgcaatttatgtaatcttgggcaaattctgtatcctttcacctttgtcacctgtaaaatgggtacaataatacctgtcttctcacaggggtttgtgagatttaaggcagtgtataaaaagggccaagtattgtgacttgccctagaaaaataatttccttcctccctctggagctctttgggaggtgggctggggtcctcatcactatggttattttacaaggttggaccttctctagatacctgatgaggccacattcaggtgggtgggtagagacacactggtttcaaacatgggagatatgactgagaaggcgatgattgctcttgctaagacaatggacttcggtggtgatgggagaagcttagtttagatgcaagcaagaatgtgctcagatggagagagaagaaggaattacagacaaaagaaatctgcagaacaccaatttttaaatctacacctatgagggatgatttcagtttgtggcctgaggagagagtgggcagggaggaattggaaattacggctcttccttcacattcgtgattcggctaaatgggtgctcattattcagagaatgaaaaaaatagcagagcctggtaacacaagagcccttttctcaaattatcagtactttataagaattctagcttttcaataatcatagttcttatagctttatgttctcacattctaagtttgttgtggtgaaaagaacaaaataagggaggatgatgagttcatgtctttgtagggacacggatgaaactggaaaccatcattctcagcaaactattgcaaggacaaaaaaccaaacacctcatgttctcactcataggtgggaattgaacaatgagaacacatggacacaggaagcggaacatcacacaccagggactgttgtggggtggggggtggagggagggatagcattaggagatatacctaatgctaaatgacgagttaatgggtgcagcacaccaacatggcacacgtatacatatgtaagaaacctgcacatgtaccctaaaacttaaaatataataataataaaatttaaaaaaaaccaaaaaacatatttggggagaagcttccaagtaattaaaaaaatttttcctttttaaaaatttttgtgggtacataatgcttgtatatatttttgggctacatgagatgtgttgatacaggcatgcaatgtgaaataatcacaaaacagggaatgaggtatccatcccctcaagtatttaccctttgtgttacaaacaatccaattacactctttcggttattttaaaatgtacaattaagttattttaaaatgtgcaatttattattgactacagtcatcctattgtgtgatcagagagtagtcttgttcattcattcttttttttttcagacggagtctcgctctgttacccaggctggagtacactggctcaatctcagctcactgcaaactctgcctcctaggctcaagcaattctcctgccacagcctctgagtagctgggattacaggcatgtgccaccacgcctggctaacttttgtatttttagtagagacggggtttcaccatgttggccaggctggtctcgaactcctgacctcaggtgatccgcccacctcggcctcccaaagtattgggattacaggcataagccaccgtgcccggccctcattctttctaattattattttttgaacccattaacaattcccacctcccctccagccccctactacccttcccagactctggtaatcatcctccaggtaatttgattcagaattttgtgtttgttttcctaaatcaataactactatacaaaacgctgtgaaaatggctactattttctttcttttgctccccacctggggacggtcccctgggtcaccttactcagcagttctccctctagatttgatccagcaaatgagatcgagtgatatattatagactctttaatcattttcaggggaattgggttgggatggaagagccctgggcctggacgtgactaatctgagggaactggatcagtatttttgggagaagcacacctgaggcaagaaactacccccaaataaaaggatgtctaaaatgctcatggttctctccccttttttggcctcgaaaaatgatatttattcagagaaaaaaagaagagaaaaaatgccaagaagttcacccattggctaacttctctgtcccctcctggttcttgccagccccccagggttgagctctggttggagtgggtagcagggctgcccctaaggtgatgtcagtgacatggttcaaatactgtctcaccacttaccaaggtatgaacttggggttcattaagctgcagttccctccatagcatcttgtaggggaattatttaagcatgtgccgtgtaccctagtgaattacaggcctcaataaatgttgaattaggtataaaatcctttcctttatgcacccttcaatcttaagacctattactgaacaatgataggaaattggtttttcattcaacagaaagcccaaggttggtcaaggtcatggtagggccagcatttgttcatcaagtttatagtcttctgagctttgaaaatgttggcagggagatcttaactgggatgagacacagagagatgaattatagtgttacttgagtaatctatgcaataggttgctgccatctttggaaccctcacttgtgaaataataagaaatatacatattgttctctgtccccagtccctggcacagagctcctaaaacccttgtaatttcctgagtgataggagtgctaggggaatttttttgttctaatgcttggcttctgctgaagttcctgagagagagctccgaatacccctgtagacagaggtgctagaattttttagcatttggtccttgaccccaattttctgacacagagctcctaaatcccttggaatttcctgggtgataggagcatcttttgttctaatgagatgactcttggtgggcacctggctagcccaacattggcctgttggccaggaaaatgaaccatgtgattaaaagtagtactactatttgatccagcaatccagaggaaaagaagtcgttattcgaaaaagatacttgtgcacgcatatttctagcagcacagttcacaatcgcaaaatcgtggaaccaacccaaatgcccgtcaatcaacaagtggataaagaaactggtatatatatatatatatatatatatatatataatattacataaatatataaaaatatatatttgtgtatatatatacatgtatacatgtatatatgcacatatatgcatgtatatatacatatatacgtatatatacatgtatatatgtatatatgtatacatatatgcatgtatatatacatatatacgtatatatacatatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatactcactcagccataaaaaggaatgaattaacaggatttgcgacttggatgagattggagactattattttaagtgaagtaactcaggaatggaaaatcattgtatgttctcacggatatgtgggagctaagctctgaagacgtaaaggcataagaatgatacaatggactttggggacttggggggaagaggaggagggggacgagggacaaaagacatacaaatatggtgcagtgtatactgctcaggtgatgggagcaccaaaatctcacaaatcaccactaaggaacttagtcatgtaaccaaataccacctgtaccccaataatttatgaaaaaaagatttaaaatgaaaaaaagatttaaaatgaaataaaagccaaagcagcttacagtaaaaataaatagataaataaataaaaataaagtattggaactttcagctccacctcaacctccaggaagaagagagaggccgaaggttgagctaatcaccaatgaccaatgacttaatcaattgtgcctaggtaaggaagcctccaataaacactcaaaagcactgagttctagaggttcctggaaggcagtgggcttggagagggcacagaagctcctcaacccttccccataccttgccctatacagttattccccccggctcttcatttttatcttttgtaataccctttgtagtaaactggtaaatgtttctctgatttctgtgagctgctctagcaaattaattgaacccaaaaaagtggtcatgggaacatgggttacaacctgtgcttattatttggcctctgaagtggggggaaaactaagccctccatctgtggggtctgttgctatctccaagtagatagtgtcagaattgaattgaataagagaatacccagctggtgtctgctgcagaattgattgcttggttgaccgtgggaagaaatcctcacgtgttttggcaaccagaggtcacagaagtgttgattgttgaatgagaggatagaaaaaaacactttgttttttcttttctccatatctcatactactgccctgaggatgtcttctatacctctacttatagcacagcatcacacatgggaagcatggccaggtccaaaattggtcacactttcctctgacctcactccagctctttattcccttctgagagctcatctgagcataccacacatcagcatgtgtgcaaaactacattacggagaagagggatttgatgaatcataaaatctcacacagtactggaaaaagtccaggataaatgggctttgaataaaataaatgccaccagaacccccacataaatgatgcatgacatcgcctgcaaattgaggcatgaaggcatgaaattttaaactcccagatggctcctccttgttcttttcaacttgtcctcacaaaacttgtgcaatagctacacctctcaccactgaacctaggtgacacctgaggttcgcttgttgctgaaaagtagactagaaagttgagtcattggggaattgaagggaagatccatggtgtatttcccccgtagcccagcatctaatacaaatttgggacacagcaggtctcagaaaatgtttttggcatgtttacaaataggaagaagagctgcctctgttcaagagaagttaagacccatcagatatctttcattcatgatatcccagtcttatgttggggtgatttaaaaggttaagtattggctgggtgtggtggctttgcttgaaatcccagcactttgagaggctgaggtgggagaattacttgaggccaggagtttgagacaatcctgggcagcatagtgagatcgtatctttacaaaaagtaaaaaaaagttagccaggcatggtggcatgagcctgtaatcccagctactcaggaagttgaggtggggggtgtatcacaagcccaggagttcaaggctggagtgagctgtaatcccacaactgcagcctgggtggcagagccagggcctgtcacaaaaaaacaaaacaaaacaaaaaacttttgcagccttttaaggaggcaatgaagtgggctttgatccagataggctggagtttggtgctcaactctagaacataataggcataaaatctctgaaccctggttttccagcactgaaaggatgataataatactaagagtaataataattgtggtataataagaaatattatttggtttttgtctgtggttcttgccacagaatttctaaaactcttgggatttctggcctggaatatgtaggcaggaggaatcttaagtaggatgggacatctagaatgaattattctattgagtaatctatgcaataggttcctgccatctttggaaacctactgcagtgaggaagtcttctgcacttccttttatagcacagtattatatactggaagcagtggacatgcctgaataagagtatcttttgttattcataatgaacacttttaatcatatctgagtttatgctaatgaggtgacttaaggtggggaccctagatagcctcaggaagaggctggtcaccagaaccaactcagtagagggttgaaacttcagtcccatccaccagtctgaaaactggagatataagctctataaaaagtcttgaacaacaaatgtccatcaacacataaagaaaatatggtatatatacacaatggaatactatacagccttaaaaaggaaggaaattatgtgttttgcaacaacatggatggaactggaggacattatgctaactgaaataagccaggcacagaatgatgaataccaactgatctcacctatatgtacaatctaaaaagtcagtgtcatagaaacagagtagaaaggtagttaccagaggttggtggagagagggaaggagaaagggtagaaaatttcaggtagactgaaggaataggttttagtgatctattatgctctgctctatggtgaccacagttaataataatgtatgtatactttaaaattgctaatagattgttaacattctcaccataaaaaaatgatgtgaggtgatggatatgtcaattagcttgatttactctttctacaatgtatgcctagatcaaaacatcacattgtatcccacatatatacacaattattatttgtcagttaaacataaactttattaggctgggcgtggtggctcatgcctgtaatcccagcactttgggaggctgaggtggacggatcacctaaggtcaggagtttgagaccagcctggccaacatggcgaaaccccgtctctactaaaaatacaaaaaaattagcctggcatggtggcgcgagcctgtgatcccagctactggggaggctgaggctggagaatcacttgaacctgggaggtggaggttgcggtgaactgagatcatgccattgcactgcagcctgggggccagagtgagacttcatctcaaaaataaataaactttattttatttatttttgagacagaatctcgttctgtcactcaggctagagtgcagtggctcactgcaacctctacctcctaggttcaggtgattctcctgcctcaaccttccaagtaactgggattacacaggcgcctgccaccacacctagctaatttttctatttttagtagagatgggtttcacttgctggccaggctattctcgaactcctgagctcaagtgatctgcccactttggcttcccaaagtgttgggattacaagcgtgagccaccgcacctggccagttgaaaataaactttaagatgtatgaattaaaaaaaaaaatcctatccatctggtgaggggtcataattatttttaaaaaaagtcttcgcgagatttgatgagcttcccgattggtgaacatattgaggtgctgagacggtggtgcacccaaagaaggcctagaagcttcatgcatattctgcatattcctcgcccctgccctagtcctgctgcaaccttacactgtgtacctgttccatgtcgctgctcctgagttgtatcctttataataaaccagagttattatgtttccttgagttctgtgagtcattctagcaaattatcaaacatgaagaggggttgtaggatttatagttgcttagtcagtttgaggcctagacttatgattggcctctgaagtaggaggagtctgatgtaactaaacactttaactcttgcgatctgatgttaactttaggtagataaatcttagaattgaattaaattgtagaaccgtcagctggtgtttggagaactggagaatttgctggtgttaaaaaacatataataataataataatgaattatgcttttacagcatgatttcagagacagctgaattgtctaatgcaccgagagtgactagaaggcaatagcactgtatgaatgcttattctccctcatgcctccccagccacttcaatgatctggcctaattccagtggcccacctccttgctccaacattaaggtccattgcaaatttgtaggtgtgtgtgacattttacccttaagaagcatcttttcaacaggactgatatgggtatcctgtaatctggttctatttcatgtgttttctaagttttctttaattgaagaaatgagaaagagggatatatttttgcagtcacagctcatgtaagtaactctgctaaacagtaggttgtgtgatggcctcagggccccctgtccccttgctcctttaccaaaattaacagtgtgccatggactttcatacagtttcttatttgacactcacattagccttgggaggacatttcaactagacatattatcactattttccaaatgagagaatggaatctcagaaagacagactacagtaaaagaatcaaagcatattaaacctggagggcatttgggagatcatgtggcaaaatccctccattttatgaagggaaaatgaagcctggatcaggaagtgatttgcccaaagccacatggtcactggtagaactgggttaaaaacccatttgtcttcttactttggtactttctcctttggttatatcatctaggcccccagtgcagattttcttcatagcaaatctagggtttaccatcccccgtccctgccaataccactgtctgtaaaatatagactcctcctcaagttagtttccctcctgttgaggcaaagattggaaaagtgtaattagaccaacaacactcagctttattaatgagcctttcaagatgctgcctgcttcccatgtgtgggactggaccaaatgggacagttgcccaataagagcccaaggaaagaagaatgtgagggatgagtcaatcctgggcatgtgcttactcaacctagactagcacatgtagttggtgggagaacttgaactgtgacagggaggatcaaggttacagctaaaaattagcgctgaatgtcaagttcaaaaggtgaggctagggatgaaattggaggatgaatcatgaagttgaagccaaaaggttcaagaaaaggatggattccgtatgagaaacgtggttcagaacctaggatgtgaacacttggtaagtgctactggtgcctgggattggtgcctgggatgtggtgatgggtaccatgcaggacaagacggcatctactgagtgctcccgcagatatcatctatgggaaagacacacactttagggaaataacattgtataatatcaaggaatgacatacatatggtctctggggaagctttttgaaactcagttcatctttcctttgatggggaaaaagcagaattagactgaaatcttttttagcctacttgtcattcagatagcatgcttgctgacccttttatctttgccgaaatcagaatccttcatgtctgctgcatgcgctgtgcaatgctatctggacttcagtgtgaagctgtttttcccctctgccctcttttccatctgtcctcacatttctgagtacagattaaaagccttgcactcattagctggggcaccactgcagccagccagcccatgtttactgggtgcccatggggtacctggcattgccctgggcacctgcgagagaagccaagggctctgacatcccttgccctgggttctggctcccaacggtgctgcagggcagatgaacaggcctgacaaatagtaatcaggaggatgaggggggactggaagtttggaattttgagggggctggagaggaatgaggttttggatagaattagaaagtgtgagattcagtaaacagttattttaaatgaaagaaagaacttccagcaagtgcagtttctattactgtccttgcagagtggcagacacacccattctcatgaattctgtaatggatggaatatgaaatattgccaaaataagtgacattccttggttgggagatgtattgaggctatttggttctgcctgcttatttcctgcttaaggaaacttttccatatatgtgcttaggagggtctagttgggatatgcactttcaaataacctgaatgttcagaatgggctcactataaacaccggcagttgccaacaaaagtataagatgggctagaatttccatgctttggatgaggtaaaagaggcccaaccacttctgaatgaaaagttattcctcactctgtctttgcttaataaaactgcactcactctgaacttcagaaatcaaaagcagctttgatttgttggggtggaaaacggtgggtaaatttttcctttttttaaattttgttttctcagaatatcattatgatatctgtgcaatgtggaaaaacaattatctgctctctaaagagatgaaggtttgcaactgaaaatacaatgtaaaagagagtatttctcttcctgacttgagaatgaaactaaaccatgcctatccctgaagacccagggaaaattccattccttccatgcaattcccctcttaaatatctttgtgcttccccagggcgcagcacattggtgtgagtctactggccgctcagtaaatacctgaagataaagggcatagtaatagctaatgtagtcataacagttttcactgttgagtgcctacaaggagccagctctggtaggagcagttttatggtcctcaacagtcaccatatgcattccttataatgagccagcaaaaaaggaattatatccaatttcacaaatagtcagcctgagactcgaagaggtgaagtctaaggccacacaatcagtaaatgacaggactgtaatctgattccaaagcccctgctccatgtagatatctcagtggcttctgcacaggacaggacacaagttgctgtgaccagctggtgtgcttctctttatttgcacctggacaggccaaggattgatgagtgggccggagcccctttgaaaatagcttttgaataacccatatgagaaaggaccagtaagttggcttggtttcttggttttctcattgctgtcggcttgaactttaatagaatgcacaccttcctcttttttagtttcactaaatgtcaaggttacatcagcgtgagccacttacttttcagggagggaagtgtgtaccactagtggcccagcatatcaacaaggcaaggaaagctttcccagtaaccctctctgtggcagggccagcagtgcagccctcttgggtgtctccacacatccctaggatgtgggagagggcaaagggaggtacccagtggccacttgctggctgattgataaagaatgatttttggtttctctctccttctccagcatcctgggggggtgtgtcagctcactgagagagaccctttttctcttgagatttctctgccctttctctgcacccatcccacatgcttgtttctcaggcttgagtagaaggcagatgttcacagtcagctgtaatgggccctgggcttgctctttatacatatatgtgtgcacttgtgcattcattatttattgagtgcctactctatgctggacactgtgttctaagcgagacaggaaccctgaactgtcttgggggtgggaagaccctctaggtacaaaaaaatgtgaagtgtaatgagaacacacttacacattctgccagagccccaaagagtcattcacctgtcggggagtgaaagtagtgatgctggtggggttggagaagtcttcatagctcaggtgcacatttaaactgaatcttgaaagagaagtaggatttgataggcaaacagggcaggaggatggagcgttctgggcagatgaatgcctatgcaaaggcctggataaacgtggttttcagagaagaaactgggaaatactcattctctgtttatgtaaatgtgatgcctcctttaagtccagcacgagtcccactttctctgagaggctgatctacactattccaggtaaccccttgctctccttttaaaataatcctgatgttggtcaaaggattcaaaatttcagtttagataggaggaataagttcaagagatctattgtataacacagtgactgtagttaataacaacatactgcactgtatacttcaaagttgctgagcgagtagatttttaagtattctcaccacaagaaaacgataagtgtgcaagatgatgtacgtgttaattagactgatttaacccatccacaaaataagcatatttcaaaacatgttatacaccaaaaataaatacattttaaatttgccagttgaaaatttttaaaatatatataaaaaaatctgtagcattatctgtctatacttaatcaactaggccttgtgttgttacttaactctccaatggatatctattttttccccttaactatactggtagcctttggaaagcacagagcatattctatatatattctgttcccctactatgacaagcatagaacagagtacttaaaaatatttaacatgtatctagaatgagccagaaaaagactttagagatttttcagagaactgccctcatttgacaaacaagaggctcagaaaggggaaatgaactttaatgaaatcatttggtggcacaggtgggatcagaactcaggtcttctgattctcagttagtggcctgctggtttcatcagctgcttccctgtttgttgtaggcagctggatagatggacatcatgggtgtgtgatgcatgtcaattgcagccttgtctcaatgccacccactcttcagctatttgctaaacctcttcatctctctccctgttgcctccacaccatcttgggggaggcaagtttgtattttcaaaagtggagactcctcagcaatggactatctcctaccagagccttctgaggacacctttcacagagcagttggcatttgtcgggggtgaggaggaagggagtggagaggatgtaatctcctgctttcacttttaattcttcaggaggaaaggtcttccccccatctctgatgagtgttttcagagtaataatcacctgtggagtaggaggggtatcccacacatttttaatgaacccagattaatgagatgtcaccaagacgatttttttttttactttaaaatgaagtttcttttgtctcagagcctttgattcagaagatctttatgaacagagatggctccatgtgagtgatgcccagaaatgccttgatcacatacagtggctcatgtgggtcctgggctaagctgtcactttttacagctatgcctcaggaagtgggcagtccttctcctattctaaaaatcaaaataggataataatgatatttccttacatttgtaaatagcaacttgcaaagtactttgagtttgataaagcactttaaatgcttcattaatttttttaaagatgctatcactgattttacttcatgtccatcctatttatttatcaaatatttattgagtgcctattatgattctaaacattaggaacacagcagtgaaaaaagacagacgatgcccctgttattgcagaactttcttttttaaaaataaaagacttttgcagaactttttttttttaaagacttaaaaaaatttttttaaggacggggtctcactgtcacctatgctggaatgcagtggcatgatcatagttcactgcagccttgaacacttgggctcaagcaatcttcccacctcagtcccttgagtagctgagactacaggtgcatgccaccacacccagctaattttttgttgttgttgtttggtagagacaaggtcttgctatgttacctaggctggtcttgaactcctgggctcaagtgatccctgccttagcctccaaaatttctgggattataggtgtaagccactgtgccagacctttaaatactttttattttgaaataattttgatctgtagaagagttaagatagtacaggaagtttgcatataactttcatccatcttcccttaactttttttttttattgaaactaagaagttaacattggcacaacactatgaactaaattagagactatgttcagtttctactactttttctactactgtcctttttctgttgcaggatataatccaggatctcacatacaattagttgtcatctctattcagtctcctccaatctgtgatagatcctcagtctttccttgcttttcacgatcttcacacttttgacgggtacttatcagatattttgtagaatgtccctcagtttatgtttgtctgatgctctcttacaattattctgggcttatggatttttggatacatatcacaggggaaagtgcccttctcttcgcatcagaggtacccaatatccacaagacgtccctggtgcagttagctttgatcacttggcccaggtggtgtctgccaggttccttctctgtgaagatattattttccatttgcttttctttggaaggaagttactaagtcctgcccaccacactgaagaggaggggaattagcagagcttgcttttaagtaaaaggagatagaaaataatggagtaaataaacatgaaaaattatcaatgaatgatcagttttgagcagagaatcaaaactaagtgatgtgattgtgagtgactgggtggttagggacagtttcagctgatatccaaataataaggagttggccatgaaaagaccagggggaggagcatgctagagagagggaacagcttccagtgcaggagcaaacttggcatgatcagaccatgcctctccccttttcaaaaccctccagtgactcccgttccaccagagggaaagccacagtcccaacactggcccacacaatctgcacaatctgtcccccatttgacctctagccccaccctacaccttgctattcctcaaacacaccaagcacactccacacttaggccttggtgctggcagctccttatggagaaactgttctcctttttacgctcatggtcatctccctcacttctctaaggttttattcaatgtcatcttttcagatgcttaaacttttttgtgtgtgtgtgtgtatcaccacacacacatgcacacacacaaacaaacacacagtgagtgagtaggtgccccagtccctagaagtattggcacgtgggttagagggaagcccactgcatatggacttttcatatgggcttggaaactttcttaagctaactgggcatgcttgaaaagccaataggcaactgtgactctttagcacccatctccttaaggttgtttttttctgacagttatcactgccaagttgacaagcaatcaattcctttgctccacgctttagacactgcctaaatttcaggtattagcaaattcttctgctccctcttcatttgctggtgactaaagaggcatatgcatcatgcctcctaccagctggcatgagttatatgatatcatatagtttctactaaacctcatacatctctgctttctctaatgaggtggatgtggatattgaggttgcatttcttttcagagaaaataaaaggcaagtcaatccatgtggtcagataaagggaaataagtcttgaataggaatctctcctaaatggccaatgaatcagcatagaaaatgcatcagtgaggcctaagttagtaccacaataattctcattttacagatgagtaaactgaggcagggagtggtaaataactttcctaaggctagtaccaggagcagagccaagagtcaagtctaagcaatctggatgtacccacaatcctctagcagtggctccagtgtggaggactcctattgtagacagtgccttctcctagcacaacatcagcaaagaaagactgtaaatatctccttactagaatggaagctccctgagggcaagaattatgaattactcataattgaacctagagattggcaaaataattcacacagtaggaactcaaataggtatctgtgaggaattaatattattcattatacagagttttggattattcattattttggattagtcattcttctgtttctttgatgaggaaggcatcagagacactggtcagactgtaatgtaggaatctattttccttagttggattccttttctacactttttgggcattatttcctcatagaaatgttttgtaaatgtggccagaaaatcaacagggacttaagggaggttaaaggaattaacatgtgtttgcaataaagcgagtcatgctatagctaagaaagtagtggttttgtaaattaaaccctgaccccagctctgaactcaagcaaacattctttttcctttagaaaagaaatcaaatacatgccagtatgaaaaaaatgcatcttccatattaaaggtccactgtaactaaacttttaattaaaatgagcacaaaaattaaataatataacctgcaatgttgatgaagcttagcctctgtgcaagaaagctatgtgtttctaacctgttgacatttttcaaaacattaataatgggaaaactatcccagtggggatatctcagacttaaatattcaaaaggtttttggaaagtgtcctacatctgggactgttaaaaagataagtcaacacagggataaaaaaaaaaaaaagtgcttgggttgttttagtaccttggaaaggaccgatactaaatagagttgttatagaccaatctcctttgcccggataagacggtccctgactgggtgtggatgacagggagctagaaagattggctgaacatgatggtgcacacctaacaggctccatatcaagaaagggaaatggggccaggcacagtggcttatgcctgtaatcccagcactttgggaggccaaggtgggtagatcatgaggtcaagagatggagaccatcgtggccaacatggtgaaaccccatctctactaaaaatacaaaaattagctgggcatggtggcatgtgcctgtagtttcagctactctggaggctgaggcaggagaatcacttgaacccgggaggtggaggttgcagtgagccgagattgtaccactgcactccagcctggcgacaggacgagactccgtctcaagaaaaaaagaaagggaaatggattctggtcaatgagtaatctggaacaatataaacaattctttttgctctgagttctagaaactgacagggagacaagagatgtggacatatctgatggacaattatgttagaaaacttcctttggtggtggggggagtccttgttttaactattctgtccctatgttagaccacatacctaaagtccgcatttttaaaatctatgacatctcatcagcctactactggaaaagacacagaggaaaggggctggtaaaaaaaaaaaaaaaaaaaagatttatttatttatttattttgagacagggtctcactctgttgccgaggctggagtatggtggcaagatcttggcttgttacaacctccacctcctggattcaagcaattcttgtgcctcagcctcccgagtagctgggattacagacacccaccaccacaccgggctaattgtatttttagtagagacagggtttcaacatgttggccaggctggtctcgaactcctggcctcaagtgatttgcctgcctcagcctcccaaagtgctagcactctgtgccagatccagtgctaaggttatctcatactaactcattttatcccaacaacagccctttgaggttgacatcattattattattattaccattcttctcactcaggaagagcctagataacttatcagaaggcacacagtaggtggtagagctgtcattcaaatgtgcttgcttgaagctaatgttaacgcctgagcaactcatctgagcccaccctgtgatttttacattgactggcagaaacgaaggagagggagaacaatgttagcagccaggaagatgagtcacatggctgtgatgtgccactgagtccctgtgatgaggaagactgttgtgacactcaattacaagatgctaaattctttgagtgtacattatggattgcttatagttattctttctattaatgggtgacactcctgtttgtctgggatgcttttatcctatttcagttatgttcatgcttctctttcaagatccggcttatgtcagaaagccttctccatccccctaatttgagtcggatgtgtcaacagcacttgagcttgtgaattttgtcaggctgatctgaatagaactgtctatcttcccactgtggcagacatcttttagggtgtctgcataaccgacagtgtctgccttcaccagataactgttctccccaccatacaggcaggtaaccaagacctatttatctacctcatcccacatggatagctgattgggtcagagaggacatcagatcctctcggggaaaaccaaatttcttctttggagaatgtggaattgggataaagagccagacagctagtcagtacaagaaggtcttgcgccaaaggaacataaacttgggagctgaagtgggaccatttctgccctctatatacacagaaaataaaaaataaaaaaaagacagctcatggggagaattgagaataaggccgtcatgcagagatgggcaatggagtaggagtgagtccctggcttataaccttgtttcagttttggcttccagttccttcatttgtccagttacccttgagttctatgacatatcccaaaggtattctagtaaatcccccttttagtttaaccccatttgagtgcgtttctgttacttgccccccaaagcactttacctaagatgccgtcaggaactagagcccccagaggacagtggcaggatttgttcttgggtgcagccctaaggtagcacagttcctggcttagttatatgaatttttgttgaattttactaacttaatatagcttttctatgagatagcaataacactacctggtcctccccaaattgccacacgctccagggaattagatgaattaaagccaagggctggctggctccattgaaagccacgcttcgcctcactgttgttccgtctcgtttccagtttgagaaggcagggaggctgggaagctgaaaagcactcagaagacagggaacagcaggagaaagtgacaagcgagacaggatttgaaaggggcttgttttgagtgctttggaatcaacttgttctttaattaagggggaaatatcaccctccagctagtaaagacacccctaagaaaattaaaataatgtaaatcaagctaaatgaatactccagaagcggcactagagctttgtaggattgagtgtttggatgcccctgaggttttaaaagcaaagcttgcaactgctttttggagcagaaacattctctcttttgtttgatggcaaaggaggctaaatgccgacaccaataggattcacggaggagttggaggtgacagaatcttcttactgtttcggctctctaaagaccagaattgaaacaaaacctaagtagatgatgctgataaattcctggggttgcttcctaggggtgttcaatgcaaagaaatcatttaacttgtaattaattctacaaagcaaaatggttcaaggggaacctagagtttctagtaaaataccttattaatcacaggggcgttttacctgggaggtgcaaaatgactgaggtgtgatggggtttgtgtgtgtgaaagctactagtatggtagtggcaggagcaggaggttcaatattgcgacaagaaaaggtcgcagatccaagtgagcagaacaatctgagctttactttttcatcaaatgtcttaatttcccaagattttaccttaaaggaggtatgaggatggttacaaagtgtgtactcaatctttggttggggggggggggttccaatgtaacacaaataatttattacacatcaatgtttctgactctcaagatagcatcatgactccttaatcaatggtttatacgtgatggcaaacttgtgcaagaagattttacttccataggcctcttggtgctggaagagctactctagtcctttcatttctggatgaaggaaaagagatctagagagattaagtggcttgccaaaggtcacctagtcgtagggtgagcatatgattcattgtgcaaactggaggacttttgaaggtgaaaggatgtactataatattacagttataccaggacttaactggtgtcagactggactgttcgggcaaggcagggcaggtgatcatcctatttagacagctcagggctttgcttcaaactcacaaggaatgaggaatattctatttgcgggtcttctttgcaataataaactgccatctgggggcagggaagggcaccacctggaggccaggaatgggagggcgattccttgcaggacctcaggctgatgggttttctccacaattaagtgtggttagtaggggcttgactgtcttctgcaggcctgagtgaatgtcttagtccattcatcagaatatctgagatggggtaatttataaagagcagaaatttatttttcaccgttctggaggatggggagtccaagatcaacacaccagcaggctcagttctctggtggaggctgcatcctctggaggggaggaatgctgtgtcatcccatggcggaaggcaaaagggaaagaaggaggaggctttttctcctggcagccttacagcaggatgccttgacactgataagaaaacagcattagaagggcccttaacccatcttcttagaataagggtttcaggaaccaactcacaactgctcatgtaatttttaagaatttcaccttctgcatgggtgctactctggattcttgttagatatggatggaggatagaaatgctgaccctgtatatatgcaatgtggaatattacacagccataaaaaagaacagaatcatgtcttttgcagtaacatggatgcagctggaggccattatcctaagtgaattaatgtaggaacagaaaatcaaatactgcctgttctcactcataagtgggagctaaacgttgggtactcaatggcaccgacagacactgaggactactggaggggcagggagagagggaagcaagcgttgaagaactgactgatgggtactatgctcagtacctgggtgatgggatcatctgtatcccaaacctcagcatcgcgagatatacccaagcaacaaacacgaacatgtaccccccaccccgaatctaaaataaaagttgaaattatttggaaaaaaatgtgaaccacagatgatgcagcttgaagaagcatgtcattgctaataaaaacaaccatttttgagcactcattctgtgcaaacaactattctgagcactttttatacattgatccccttaatccataaaactactctgcaaagtgaaactgttctgtctcctgattgtgctgatggtcatccaaatctatatacctgttaaacttcagagaactttatgccaaaataaaaaagttaattctactgtataacttaaaaaacaaagtaaaaaaaaaaagactatatactgtataagtccacggattgaaatccaggaaaggcaaaactctagtgattgcaaatcagtgattgccggggctagggtaggagggaaggactacagaagaacacagaaactttttgggttgatggaagcgttctagaccattttggtcatggttacacaactatgtatttgtgaaaaagcatcatattgtacagtttaaattcttaaattttttttgtatgcaaaccatacctcaacaaaactgggggaaaccaccctgtagaatggacatcactcatatttgtcccattaatgaggaaattggggcacaaggaggttgaataaattgcctagggtcacagctgatagagccaggattcaaacacaggaatgaataattccatcaattttcacttccacaattaacagctgctcatgcaagtaggtcatggcccttaacctgggtcatgggaacacattagccctagagaggcagctgcaacaggtagaaaatgcttgacccccacagaggactttacagaaacagcagctgttccgggatgaccatttgagtccacacacaattagtctttcccaaagcagacacaattacttgatttgaaaaactggtgccaggatgctaagtcctgatgcagatatctggtggcccctgggccttcccctttttcctggctgggagtgtgatttaaaacctcctggctaagctcattttgccaaatagctcctgcaggattcatttccaaggctgagtccagaaatttctagctcagcaaatagatccaaagcaagatgacgaattcacccaagctacctctgagactaaggaatatggtttcttgtgctttgcagaggcaaacagatgtgtttatacacaaatttacacacataaaatgccttgcttgttataaagaagagagaaaaaatgtaactgtacatctgcatgtacagtagcttccatctgggaactgtaacttcccagtagctgtccatctgggaggagaaggtgaatgaaggaatgaaggtcctccgcaggaacacagaatgatgctgtgtcatatttcacaccgctgctgtactacttggagaaataggctcctgtctcactttacagctagaaacagtgcagactgttcttaaggctgatgcagaattgagaggaactggaagatcatctcaggtaacacaatcaggcacttatgattagaagaatggacttacccaggatcaagcagctacttagtggcagagccagagaggtaaggtgactgtctaaggtcactcagtgcatagctggagtcagagacctgggttctcttccctggaccaaccatgcaactgaaagcaggttctttaacctctcgaggtttctgttccttgaatataaaatggtgctaataagtgctagctcaaaagcttattgtgaggactgggtgtgataaggccctaagcacaatgcctgagacacagtacatgctcaataaattacagctgatggtagaagtcattttagttcaccgtggttatgctaatgtatcttatcttcagtttgggctagatgagttctaaggtgaaccttagaacttagttattggctagccaataactaactgacttgtacagcactttatggcttaaaaagccctatcacagaagagttttctttgcattgcacaattaccctataatatatatatagaaccagcacaattagctccatctcccagtttaagagactcaaaaagccaaagcagtttactgaattctgccttttccaagatcacacagccaataagtggcagagaggagtgctgaagtcagatcttctaagtcaaaatgttgccttctgtctggtggcccaagtgtccaactcttaggccattgtccttcccttagtgtgtttgtccctgcttccctacagccccccttccaggccaagccaaccattgctcttggagtgtgcctctcaccagcagatccaatgaataatcatgacagtaaccctactgttgcccttttactgcagagatggggatagatttatagaggctgactgtggctggtatttgggaatggataatcaccttcacttactatatcctaggctgcttcggctaaatatttactgcccagaattctgccctttccaaccaattctgaatatgagcatggcacaggcaactaagtggcataattcatttggggcaaccataaatctaaggcttccaccagaaatgatgcaaaaaattaatggaacatgaaatcaagtaaatggaattgagtacagtaattagttcatattttaatcctcaggtctgtttattatctgtcaactggcgagcaattaagttggcaccattgaaatgattagctttgtttcagcaaaagtttatcgatatgtcagtgcaaatggatccggtggttttaaatggccttattttgaattgtagagcagcacatccatggagcagctagacatcgaatgatttaatttagcaatattatctggattacttatatttaatattactgaactgttctggagggttatgggggaatgtgggcgggggagatttaaactgcacaaaagcattgcttctgttcttaggttcttaatgcaatagtatgattgccttttcatattgagaccaaggaagaacatttaagacactatattttagtcttccaatctttaattctcacatttatctcaatcaggcactattatggctcgctctcacattggtggtcttttctcaggggtgatttggtgatttctagatccacttccttgtggatgctcatcatggcttatgttttgtgaaataatctcccaatgtctttgctgttttgaggctgactctatagatgcccttgcgatggggctgtgctcacaaatgcaggaaatgtgattctcaggctctatttgctctatgaggtgactaaaccaggtgacctaagaaggttttttgaatcttgggatttgacagaattctaaattttatttaaaaagttaaaaatccccaattaagagtcaggaaacttgggttctggtcctaattctgccgctaaatctctgtgaccttgggcaggtctcttgccctttctggcatttgatttttcctttgtacacacagggggtatgctggaagagatggcctcaaaagttcctcctctgacactgtcactttagatggacacttggagtagacttgtcctttccaagtccaggtctatgtctggaagtgagagatgtgacctttcgtggaacctctacaaattttcattggccactgatagtatcagagtcccaacgaatataggtcattcttatttaacacctctttttcaaattgattttattcctgcagcgttggaaatgagttaaaaaacacagctagttcacggaaatgttgtgagcggtactcatgcctgtaactgcagtgtcactggttactaaataaacgaaggcctcattcaacacttgtaaaatgataatagccatggtctccatggtgacaggtctgaggcagaaccctgatcaaattccagttaatgcctgtctttaatattgtcttttgtaatgtaacaccttcctcctttcttccgatgaagcatcagcagggagatcagagtcaagtggaggaggatggtggctgtcatatgccatcctgggggtccaggccagagttatgatgcagattaggctggagtcaatgggataatgagttgaccgcaggaggctgtcttctaatgcaatgccctctctcttaggctgcactagtgactatccaatactggcaattcaggaactgctgacttgattgggctgtgctttcccagaagtaattataaaaatgtccagagggagaacttcctctccttagatcagagtcatcatatgcttgctggtattgctgtaatgtgccctaccaccatctgagcttctgcctctgctttgcttctcgaaggccagtttgctcactctggtgggactggctcttagaatctagaaatttgatgtctagcattggcaaagctccttagtctgatcctaggagtaattccagggctgaaatgaggaatctaaatgaatttttctggtacacaggttctcaattgttccattatttctcccaggtactccgaatttacttaccttgtatttgtgaataatttaacataaaaaattctagaacctctgttaatattgacaactttattaggtttgccattatgactatacaatttaattcatgatctattgggtataatctaggtactttgaaagctacattcttaaattatcttcatttactcatttaatctctactcagcaatacgtaccctgtgcccattatgtgtatggggagatatttaaaaactacaacatactctgtgactgtagggagttaacagtctgattggaaagacaggatcctctactatactgtaggctccttacaggtaggcactatggcctatcagtctttgaatttccctaccaagctagggcccagagcagatgcgtaatcattcgtattgggtttatggataaattgtgggctatattaggcagtgttatgaatcagaagacccgaactaagtccaatcttggttatttattgcctggatggtcttgggcctttgtttccccaagaaggtggtaacattgagagcaaccgccttgaggtttatgatcaaatgggagaatttctgtctctgtgctttggaatttattcagagtaaaaaccaaagtccatacaaagtgcacatagagaggacccacgtggtctgcagcagcctctggccctgctctgacctctccgacctccttccccatcactcacacatgtgctcatgctgcttccgctcttccttgcatgctcacagctccctcccacttcaaaatcatggtactggcgattgcctctgcctggaatgtccttccccagacatctccctggcaacctcacaaatgtcatcttctcactgaggcctatactggccacactatttaaacttgtagctcactccttccactcctcattctctgatctctcttgttttgctctagttctctctccatagcatttatcatattctaaatttacatgtaaatttactcatttattatgtttattatttattatctgtctccccccgctagactataagcaccttacaggtagacatttttatttgttttattcactgtagcacataatagacaatcaatatttgttaactggatgaatgaatgaaggtaaaccacaaagcatgtgaacagtggccaagtgttggcagtgagattctgcagccacctatgggcatgactgggtgagctctagattgtgctgcacagtaactaactcaagtctgtgccttgtccttccagtggctcttaaatccctccagggtagcgcttaattgttcaatccttttgtgtcctttaccacatttgggatagggctaggtggggtgccttctaaatacattttgaatttctgaaagcatatttctttcccagagaaattccagaacatgtcttagtagtaactgcaaactgaaccactcttcctcttttacagtttctaatggaatttaatgctttgggtagccttcatataaacactccatcttcaagttaaatggggctgtatatttctgtatagtgaatggaggcaacatactttagaatttcagggaaaaaaatgcctataagatttttgttcctgggacacaaatggttgactgagttgttgattcagtggtttaatgactcattccacaaacaccacttaagcactgactgtatgtcaggcactgtgctaggtgcatggcatgcaaagatgaataggtcttgtccttaagaggtttaccaaggtcatttattccctcattcagtaaatatttattgactatcctcaagtccagacaatgtatgaggtgttgggaacacagcaatgatcaatataaaattcccatcaacaaaggactatggttccaatagaagtgagattaaacagttacaaaacccacagtgatgggcaacataatagattggggtcagctaaaaaggccaggtagtaaatattttggcttctgcaagctgcatgtggtcggtcagtttctctctttttaatagcatcctttaaaaatgtaaaccattcttagctcctaggctggacttggtccacagggtatggtttgtaaacccctgtaatagatgaatacacaggatcctctggaagtcaaaaggaggcagcaccttcctgtctgggaggagagaaaggggcttgggaagctatgatggggaactgtggtggatgggggaagggagatggggctggcattcagagtagagggagcagcttcaccatggcatataagtagcacttccatatgtattgtccatgtacctgtccttatacatcccaatcctcatttcctctcaatctccaattgtgtcaatggagcatctctaccaggaggtcgtggcagagcagcaaagtgctaattacattgcctgagcactcctcacaagccattcattgcctaatggggccctggctctcaaggatgttctcctcagcacttttcataccctagcacacttcaggacaatttgatgttagttgcttattcctacaaatttgtgttgctttagtgaaaccagcctctcaaggatgcaaataattgattcctggaagaggacaaggcctgcattttctgttgttttgtttcagttgttggttctgagataattgttttctcttttctgattcagagccactgagagagagagagaaagcaagagagaaagccccatattttacatatgactttaattctccccttttaatgaaacacatcctatctatatcaccatagcaacagctatggacttttccctctctcagatgtgttttgagcaggatcagagattccagaggctgagagctagcaaggtcaaggtgtttctatcttgctgtcagagggagcagcaagtgggtcaggttgcacagctgctcacccattctttgcttaatgctatctagtgagagctatttcataatccccttctggaataagcttcaaatataatccacattatgtggtattatcaatatacatccctcaatagactttacacatctgtgggcagaagctgcactctggcccatgcctagctcggagcccaccacatggcagaagcacaagagcatgtgaagagtggatgaaattaacaggaggaactggctatagatcttgcatgaagtggctggtacaattctccgtgtacccttctgcccccttgaaaagaagaacttaaggaaggatttttaaatgaacttgtctaatgtatcccaaatcaggaagattcttcttgtccagcccccactactgcaatggaatctaaggcatgtttcttttcaaatattattttttccctggctaatgtattttcttcttttcataaatatcctactttatactggacattaatctaaccatttagacatgattagcaagctaagggtcttacttattaaaaacagttcatttttccttcttaaagaaatggagacatttgaatccctgaatgtgctcatttatcaccaatccccaacaaggaatccaggagttctctgtgtaggacatgagtaatttttataaaaatgcagttgctgactatgtcatacatccatgcagctttataaaacaaagcaaatgattaccatcaattacaataacctcactagacaagactgcaattaatctatagctcttcagataacgactgttgcactgtgccaaggaaaatgcctggcattaattgacttatcacgatcagcagtgatagatagggcagatggcaatgtgatcattcactgtcaacaaaataaacacatgctttcttgctagaagtgtctacttgggtcctctcaaaggatagccaaaaatagaggccaaaggtggctttgaaggtagcacaaaataaaaattaagttaaccagattcgcgcaatctacccacataacaaacctgcatgtgtacactttaatctataataaaagttgaaattcattttttaaaaagttaaccttcagggtgagatatgttgacttttactgaggctaatcctcagtagaatacaattgaaggaaatttctataagaaaatcatggattggtgcagtggctcacgcctgtaatctcagcacttcgggaggccgaggtgggcagatcacttgaggtcaggaattcaagaccagcctggccaacatagtgaaacctcacctgtactgaaaaaaattagccaggtgtggtggtgcacacctgtaatcccagctactagagaggctgaggtaggagaatcgcttgaacccaggaggtggaggttgcagtgaaccgagatcatggcactgcacttcagcctgggtgacacagcgagactccatctcaaaaaaaaaaaaaaaattatggattgtatagaatttcagcatcagaagatacattaaaactgacagtttcccctgctcattcgaatgtgagtcacctttatggagtcaccaaattctgttcagtgcttaataactccagtaatggggctgagtgcagtggatcacacctataatcctagcactttgtgggggggccaagacaaaagaattgattgagcccaggagttagaggttacagtgaactgtgatggtgctaccactgtacttcagcctgggtaacagagtaagaccctttctctctaaataaataaataaataaataaaataattccagtaatatgaagtcacaattttcagaggcaaactcatttcatcactgtatcgttttcatcgttagaacacatatgcagctgaattccatctttttgtagctaccacccattggccataggtgtcttcccttatgctacacagaagatgccaaactcttcttgcttgctgaaatccgtaaatgggatctcaaaagtcaactgcttatcgcactactttgcatatagcattgtttcggggactctgaaattctggtctcttgcacctaaacccataccagttcgtctatagacccctgacattgagaggcttggaaagaaatgtgatacgatgactgcatctacccagggcaaggtagattatacctatgctgaggccagtgctcaagcctacattggagcagtggatgtgtgtgtgtgaccaccctacttgggaagctgttctccaagtctcattagtctagatagcatcccagccttgccatttccaggggacaattaccaatgtgtgtgccttcccccctttttagcagtgtgattttgttgattaagtcccctttgtttagaaaactgggataattcaggcggagtttcacctaaaattgtcacagtggtcgctaaccaaaatctcttggggaaagttttacaaatgtacaaacctggatcctatatcctgagactgattcagttggttttgggaaggactgagaggaaaatattttgacaaggcttcccagttcattgtgatttgcaaccctgcttacatgctttcttcactcattgctttcttcactgggaacacataataatgtaccattgtggaagtgcttcacaaacctaatcgtcagactctcctgggaacttttaaaatgcaaattctttggtgcacctgatacctgtggtctggtgtaggtctaggaaaattcatacactaagagatcaaattactatatgtttcccttaaggattttggaagcactcatttactctaaaattgtggttcacgtataagttacaaagcacccttatcatatactgaagaaacaagtgtcactaaagaataatacaatgtaaagattttagcctagtaaacatctacattttatcaattattcatttaacaaatatttctactctgaagcagtgttgtgataggtgctggaatatgacagaatatgggggagaaaaagaaataacagcaaacaaaaaaatgagcaagtaagtcaacagataaaataattacaaaccttaaaataacttaagaggaagaattcatctaattttgaatattctctaattcagaccggcagtacccagttatgctcaaattgtgactttctgtcctgctttcattacatttcttgttgtactctagttcagaatctgcaacttgggagcctggcattacaatgcctttggcagacatccctaatcaatcctagtattttttttccctacagatccaggagggagacccatactacagctcaaccctattgtttatagagtcatgattaacagatcacagataaaatgctagatgaaatcatgcagcttctctagcacacactgccctgacatgcctcggggcttttgctcgcactagccctcatttcctgctttgtcattgttgtttatcaatcattgagtactttcagtgtttttacatctggaatcccacttaatttttaaaatggaggtgtctaaactgtgccttagaaggctcaagtaacatcccaagatcacacagtgtgtatcaaagcaagactacaaaactcaggtcactggactccaaagctgatggtcttaaaattgttcatcattgcctctctttacagcccagttcaaggggcaccttctctgtgaagcttctcctgaccccttcaagcaaaatttaccacttcttcctttgagtttgccagggcctttgtacatccccattacagcatgacattatactttaatgacttgaatgtagcactctttgagctcctctgtggtaggagccctttttttaaatctctgtatccctggtaactagctgagtgcctaggcaggctcttagtgacacattttggatgcacattaaaatctggctgctggactcattaagattgtgggtctgtttcttagtgcttggccttaacacactaaaaataaggccagatttatacatgatctttaaaaaaataaaaacaccacatgcaatacatatttttgtaatttcaaagccttcctaacatcagttattgaggactcttaagcagaaacctagtcacagggcatttagcctgtaaggacccctgatctctagttcataaacaccctccagtataacgggggtaaaacagatcaaattacctacaccctacttgtgaagtgtcacaccacagatgacaactgtttaaactgtagctcttgtcctataaatgaaactgtggttgggctctctgctgtggcctgagttctgtctgggttgatggtggcacacagtgacgtttccattttgcagaaactcaggaaaactattgagttgcctgacacttatttcacagtatgttatagttttatgcaaatatgactcattatattcaaaagaaaagttatggaatctgtgctatcatatgtgacacgtgagaggctgatcgcccagataggtgtaagtaaagatgtattatatatataaggtgaggatttggggttgaaataatgctctagaaatatcactggacatgagtctcaagagagctgcaacattgtctcagaaggaaagagctagtttcattgtagccttccctggaaaatactagaagcttgttattgacttcgatgtcaatttgcaaaagacagatggagaaagaaggcatgggccttctcatttcatagattagagcgaatccctttgttatgttatcccatcttggacacaaacaggcacccaatcttataagttgacatttaaccttagtactttgacagactaacatacctccccagagaaggcctgtccattgaggaggtgctccgacccttggctgtcctcactcccaaagtgtagtcggatctcctccagccggtggctgtatgtcatgggccctccagatatgttgaccaagtgctccttgtccaggcgaagggatacgtgtcttccagtgttgtacatggtcccactgacctgcaaggcaattagcaacaggtcaagcaaggccctccttcttctatgcctccccaaacccagcatggtgcttggatcaacaccttttgcttcctcttgatgggaagatgggctaaatccacatgtggagtagggcgtggcagctgccccagagggtatatgtgggatctatggtaatttctgtgaggcataaaccacatgatggcttaggaatttgaggtaagaacttgaaggagacttttcatcatttgtgattaatattttgtgcattgtattttataaaaaatgaatttgtccttcttactataaggatttggaatggaaagatactgcaagagttctaaatctcagctgtgagaaattggagaaagcagttagcaaggggtgagatattaagaaggccaaatgagacagggaagagaaaatgagtgactagaagcagacgctcatgggagatggaaagcctaggtctgaattctcaagcgtcctatctggtgtgtcctgccctgcaaccagacattgcacagaatcctcatagcttgtgggcctcaagtggtaaactaaagggattcactcaaacttccaatttcatagattcctagacttactccttattcctgattccatcttgctccagccccttcaaactgctaacatgactgcttggcattccttttccttcttttcttgctgggacttgatgttcagcttcattttcctgactgtgacctcaacaacaattgattctagaacactcattcccatctgaaactctactttcttactctcttgggttgacttagctctgggagtaggatctagagcttagggagactttgaatgagtctggaaggagtgtttctgggttacaggaggctgaactatttggattttcttcctgcttactctgactttgggccaagccttcagccctagtgattcctgaagggcttcctgtaccttctgacaccttcattagatgtggttttcatatatgtgctctatagcactatcttttacctgcctcttttccacctttctgacactggtgttgtgaatgattagctcttgagttgttcactgtggcagagaccataatgctcaccaaatattccagtgactcattttgtttcctgccaccttactgtagaatggagcccatgtgactgataggggccatgggttgggaggggtcatgacaagtgtcacttccaggttgaaatagtggattccccagactcacctttccctggtacatcgaccaatggcattatatggaaatggcaatgtggtgcagcgactgcatggagctcatgtcagcctaggcccctagagattatgtgcagtttacaaaaatgacaggaattcttcccctccctataactacactcccaacaatgtaattttgtaactgctgtcatctagataagaggctatttctctacgtcgagtctgggctggccttgtcacttactttggccaacagcatgtgctgcacacaacatgctagtcctgagagtagaccttgagggcatgcgtgttttcttcacttcttcgtggagccgtgaaactaccatgcaaatgagcctgggctagcctgctggaggatggggccacagtgaggagagccatcccaggagaggccgtctagacgggctactctgtggctgatccactagctgactggcccagctgagatcagcttagcctggcccaggtcagaaatgtccactgacccataggcttggagctaaatgattatttaagtctctaaattttggggtggtttgttatgcagcaaaagggaactgatagacactaagtcagtcatcttctttctcctgtgaaatctggaactatcaacagaaactctccgttgagttcctgaactgcaaggtcgcctgagtgccaaccatactgttaagcagagaaagtcagatcagagagagaggactgaggcagatgtcccaacattgacagaggagaccacacactggggaacgggggagggaatggggagaataactacttcgcttcagatatctttgtgtctcttcgttctagttccttcaagaggcctgaactgtactttctaatattctacaccttaccaatacatttttaaacctcaagttatctattccttgcaaccaaatgatccatgccaatgacttcactcctgttctccagcctcaaataaatgtatatttagttagtgtgagataatcagaacttttcatttcccataacttccttttcagtacaatagctcaagacagatttgtgttagacgtgacttccatctctaaatataacctattttttctaattattaagataatacataggcattattatatggttcgaaagatatgggacagcaaatcgaccacaatttcacaattaaacaggaatcaccactaatattttggcatatatataattttcacactcatacttatagacccataatttaatgagattttatatatgtgcattataaatatataatatagacttttcacttgcatatatgtatattatatatgactttttatgttattctaacatatagatatttccatgtcattaactattctttagcaatatcactttgaaatatctacatcatatttccttgtaaaaatgtttagctgattgttgaatctttacagccctttcactttttcattattgtaaaaaaaatctgtaataaacatcctcatggataaatcttttcacgaatccagagatatttcattatgcaaattccaggtcaaatagtgtacacattattacagcatttactatgtattgctgcatccatctgctatggggagtagatcccacagagcagggctggatctctgtaattcccttcaaatgacattaagcacagaaccatgggattcaatctagtgacattctgtggtataaaaggcaacaaaaaacattgctccaagttcctatgacatgcatgctttgtgccattgggcaagtatcttgggcttcctaacacttctagaaatcctttcatctatgtctgtctaatgttctcaagaaaattattgcccattgaatcaaggcactgactacattttatgcttgtgtgaattttcccagtacttgggaaacacactggcacaagtaggtggaaaaatcaggggccctggagtcaaaagattctcagtctgcctcttgcgacctagggtagtttactgaatttcttgaagcttcagttttcttaaccatagaggtaacagaatttcctccatgaaaatggcagacaaaaaagctataaggcatattgaaacaaatagcaaaatgacaaagtcccttcttatcagtaattactttaaatgtaaatggattccacttgtatgctatatctaaagtagccaaaatcatagaaacagaaagtagaatcgtgattgccagggactgagggagggaggaagagagagttagtatttaatgagtataaagtttcagttttgcaaaataaaaagagttctggaaacagatggtggtgatggttgtacaacaatatgaatgtacttaacaccattgaattgtacacttaaaatggttaagatggtaaattgtatgtcatatgtattttacaacaataaaaagttggtaaaaattgccctcacgaggttgtgataattaactaatatatgtgatggtcacacgtgttcattctcttccttcccttactcttggctattatggcatgggtgcctaggtgatattgaaggattctcgttgatctttcttccccatgtcttccccaattcccagagcctggtggaatataatgttgcttgctaaatgtcataatgaagaactggagctaacttctgccttgtgatgattcactggcctctcattttggattttaaggtgctagacatgaggagaatgcaagatcatattgaaggccatgaagcaaaccccaaaccagaagcaggaatacaccaatgtgccttctagttcttcgatctcacttccagaccccttctgcatacatggctctgtcttcattcattcattcgcttggccatttactcagaacaaaacattcaatgcacctaacagtgtgctaggagctggggacagtatgactttgaacaaagccagtccctctccctgccatcatggagctcacactccattatggagagacctgaatgggggcacaaagttatgggcaatccataactgctatcattttcctatgtgttcttacaacgagatgcaacacccccttttccccactcttcccatagataccgaaataacattaatttgtattaatcaaaaaaagctgtgtagccagggcatggtttgttgcactttaatttaaaaataaaggcttgacaacgttatgtatgatatctgagggtacatctgcaccgcagtaattaacattgcagcagtgccattttatctcgaatgctaattactgtgttttcaatgaactatttgggtgcgcagcatgttggaaaaagttatattatacagaccaggaaacaaaacagaatggagaagttgaagctgcaggggatatccaggttgcctctggctgcctcacagttctttttgttttaccttaattcactgcaaaataaggtgtgagatgggtgtgatgtccattttaccagcaaaggaagtaagcgggggctggtgaaggttcagtaacttatccagaatcacacagtggcaggtggcaaacccaggtcttctgattccaagactaatgatctcgatgtaagcaaatgcaagtgtccttgctcatttcagattaaaaaaaaatactttggggggccaggtactttggctcatgcctgtaatcctaacattttgggaggtcgaggcaggcggatcacctgaggtcaggggcttgagaccagcctggccaacatggcgaaaccccgtctctactaaaaatacaattagcggggtgtggtagcaggcacctgcagctactcggaaggctgaggcaggagaatcacttgaacccaggaggcagaggttgcagtggctgagatcgcgccactgcactgcagcctgggtgacagagtgagactgcatctcaaaaataaataaataaataaataaaataaaaaacaagtaaataaaaaatatgttggggattttcatttcttctccagtctctatttgcagatcttaggcagttccagaaaaagtgggatctttttcaggaaaagagaggactataattggatgctagcctgctgaagttcatcccaggaggaggcttcgagaaacctgaaggtcaaggaagtccctcaatttcctcacctgcggaattcatactggtttgagactggttggagctacgtatattgagggaagcaggtaataggtgctccacagatgtgcctgtccaggttgtatgtcaatcaatattatcttgataacttgagaccatctagaagcactatgttcttttgcaaagcaaaaattgtatgcctggtgtatttattttgcaaaattagatgtctttgcatagcaaacacagtgctttgcagcagtcagtgatttggggcctctaataaatggggtcatcttttttcattctggtgacactatcatgtttagagggaaataaatttggtcaatgcatttttaaggtaggaaaaattttcattctttgaaattcagccacaatcctgttcataaagatggcatcttggttagaactttactgggtgccacagggggtggcggtaaattctgaacctgaattttctctgttaatcatcacaatttctccctcaccaaacccagcaccatttgcttattctcagtgggaagatattaggctaaacccatatgtggagggaaggcctcccacagggcatacctgtcttacctggtttctatggcactttccatagaagcaaactgccatcagtcgggggccagaacttgacctcagctatctttggctctaaagcctgtgcttttaaccactggaaattattaggttgtgcagtttttgtttctgttttttgatacggagtctcactctgtcgcccaggctggagtgcagtggcgtgatcttggctcactgcaacctccacctcccgggttcaagtgattctccctccacagcctcccaagtagctgggattacaggtacctgccatcacgcccagctaatttttatatttttagtagagacggggtttcaccatgttggccaggctggtctcgaactcctgacctcaggtgatccacctgcctcggcctcccaaagtgctgggattacaggcatgagtcaccactcccagccacagctggttatttaacaatgtaatattacagcattttcttcaagaggtgggttgagagtgtaggagcctcacagtagtttggagctcaggatgtttaggattacttactgtttactcagggttctctagagaaacagaatagtgtgtgtgtgtgtgtgtgtgtgtgtgtgtgtgtgtacatatatatgtataaagacgggtaaaataaagagacaacacatgcgcacacacacatacatactactgtgtgtgtgtgatatatatatatatatatatatatatatatatatatatatatatatatcacgtaaaataaagagattttaagaaattgtctcatctaattatggacattggcaagtccaaaagcctgcaggctggaggcaagagctgatgctgtagtttacctctgaaggtaccctgcagaattccttttcattcagggaggtcagtctttttgatctcttgaggccttccactgattggatgaggcccatcaaccttatgcagggcaatctgctttactcaaattccactgatttaaatgtttatctcatccatagacattctcacagaaatatcccaattaatgtttgaccaaatatttgagtgccatggcccagccaagttaacacatcaattaaccactacacttattttcaaattctatttgccttctttattacatcagttcaaatagctcttaaccaaatagttgttctgataccacacataaagggttatatatataatacaaatatgcgtgtgtgtatatatacatgcatatattatatagctacattatctatatctgtatatattatatatacacatatgtatattatatatgatacaaacacatatgcattttatctatatatttcctacatcacataattttaaaagtcagctacacaaagactgttttccaaatgtcagtcacatagaaggagaaccagtttgaaaagatgtacatctgaatgatagaacaattataaagaaataatttaacttttcttgttaaagaacaaggcaggtttatccttgagtatagatgggaccatggagattattttgatgtaaatcccctattgttttgggtcttagatgttgtataaactcatattttgagataacaaagaggaagaggtatatctttttataaagaccaattcacaaaatacacatgtcaaaggtcttttggtttaatggagatagcgcttgtagggtggatgtttactgcagaaagctaagctagaggaaatcttaccttcagaaattccaaaagattcaataagtagctacttgcttgatgtgacacaaagattatgtgaggtttccgatatgttctctctcaaggcagtctgactcagatctcctctaatatagtaaaaaataattctctacagcttaaatggaaatataacactaaaaatggagtagctgagaggaaatagaatttcagtcatgcagaaggaagagatggcctatctgacgtgtacaggagctacttgcattcttaacccagttagttaggaaaggaagggtggaggacacctactaattggaggatttactatgtgtcagatgttgtaccactttttagattagaaaaccaggtacaggtcggctaagaattctactcaaagatacaaaaggaataagtgaggggactagaattcaagtcttcatgacccaagctcatgctcttcccagggtctcaaggagtagcttcaaagtcactgtagagagggtgcactcccatttctcagtgaccatgtacatttcagaaatttcataatgtcctttttatttatttactattctatatggaattggcacctgggccctgttcactggtaacatagaagagccggcattcttgcctttgagatttgggatacagtcttcttcagcagattttttttttttttaaccaacaagaatgagcttgaatcaacagattttcttttactataactataaaaatacataactataaacacgctgggagctgatagaccacaacatccacaacagcggcttgactgtggtgtactctgggctgtgtactcagtccctttccatcatcatctcatttcacccttatgctgcccaggtgaggaaggcattatccatattctgcatatgaggagacagaagctcaaaggggttaaaggatttttacttaaagcaccacagttagaaattggcagtcccagaattctagcccaggcctatttgactgcacattctatagctctttaaaagagaagaagtcagaagttggtaggaagagtgctgagtgctggggaaatgaggtagttgtttttttttttttttttgagtctttgctctgtcgcccaggatggagtgcagtggcgccatctcggctcactgctgcaagctccgcctcccgggttcacgccattctcctgcttcagcctccggagtagctgggactacaggcgcccgccaccatgcctggctaactttttttttttgtattttttagtagagacggggtttcaccgtgttagccaggatggtcttgatttcctgacctcatgatccgcccgtcttggcctcccaaagtgttgggattacaggtgtgagccactgtgcccagccatgagatgaggtagtttttaaaaagcttctggggttagggatcaattcttaattaaaatatgatgtctgcatggatatgccaggttgggtttaatgtatccagacctggtctagacccagggtggcagggcagttccagtccccgcttgctgggagttgagagatgggtcatacctgcctctcctagtgttggctgagcaactgggtggctgagcccaaaatgttgggaggccactcagtgaagaagattcaacggccgtgtcatgaattaggtgacctttctttgcaaccgaagtttcctgttatatgtctctggccactctgctgaggtgtgtaataggctttctttgcaatgtaattagtgagtctgagatttaagaacaccacttagtctagttttctgcaaagtagctcaagagatcaaagggctgatttgtaaagagtgaatacaaaaagccagtgtgctgcctgctcacatgggcactctggaagcatcgacgcaagaaaaaaaaattagtaccaaaaactggagtcaaatcattggcttcagtgcagcatagcagacacacagattagcaaacttaggggcgtatggattctaaagctaaaggacttcagagatcatcaagctcttattcaataaaccaggaaactgagacacagagtggttgagtgagttgtccaggattatgcaaacaagtagcaaacccaagattagaaatcaacccactgagtgtttcttgctttatgtagcactcttccccctcctcttattctcttgcttttcctttaaattatcttatgctgagggtacctaagaatactgactcaaagttagaaatgctagagtactataataagtgtgtgtatacacaactaccatagcctatagaaaaacagaaacaattcaagttgacatctggacctgccatttacatgacatgtatctagatactgggctcttctcactgtttgtccagatgttttatgctatgtagctttcatagtattgattagaaatggaaaagattagaggctagataagagcatggtggcagagggtgtggagctttaggagtaggccttttttttttcttttgcaatgcatctttgaaagaaagcagaagggaaatatttggagctcgtaggctggggctgttaggaaaagagtggcttagatgtaggtaaataagaaaatggaaccagactggagcgatctgcttcgagttaccattggtgggattgggtaggagagttgatgtacttctgagatctcacccactactcttaaccctgcagggaaaatagtgggtttttttcccttagtaatgctaagtttacgctgatctttctcttacctatccatctgagtcagcctgtgtttcctctgtaaaaaggataggattttggcatctacactgaaaaactagatgaaatgatcacatgcactgcttattatattaaatcatattattattaaaagcattgaatctgtttttgataatattgactcttcaaataatacatgatttatttgcacactctgcagggatgctaggtagcaccattgcagtgaagcatctcttcaacttgattgatcttggtaatgacaaaagacacagagaacaggtgtgaaagatattgcttggttcactaaggcgtgggctaaatcaagagaatgctccctttcctccatccaacccaaggataccatgggctcatggctggcattaggctgaacatgttcttgccacacgtagtcattggcgctgaagcccttcacctatttcaggctgcccagcctctgaccaggaaggcacacttcagagagtggtatctggaatgagtttttccctcacaatcctggtatgtaggtttccggggggtgagtcccatgtatttctttcctactgaaccaccactgccaaccaatggttttattagtttaatattgttattttaataatttagtattataaacaaaatttaaatttgttaatttgtcttctgtgtctgcttagctgccttatgaacattaaaaatcctgacacaaaaccttcgaggtcagcatgagcttcccattttccagtaagagggtggtgccacatgctcagctcatatggccagtgggttcaagagccagactgtgaatgcaagactgtccgatttcaaagtcaatctccttatgcttcactgtgcttctcttaagtgtcaacaagcaggcctaatccgtatgaccccagttcagtgtgggtttctggtttagttctccaattcctttacctgggttaaaattcggctttaaaccttagcccactagcatgtggagagcctggagagttcttgtcaagcccctcattgttggttgtctggatcaatttttttttcttacttcttagtgagtggctggagtcttatgccaactggataaagttattggaaccaagatggtaccagctgattgattagcagtatgcccccaatggaattgcctgtgctgctgctcctttcatgagttgggggctcaccttggctatctatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttggtttccatttgttggatgaaaatggataaggttttgctttgagcatcatctgggtacctggtccaagctccaccccccattctgcctcagtaggtctgaggtgggactcaggaatctgatgtcttcctctcctgagcttcctttgatgttcatttgagctgagtctgacagttcttcagtgcagtggggaaggggtacagtaatatagagtgactttttttttatcctttctccatcctcccttcgtgccttaaggaattgctttgataattataaagatatagcactaaagctctttctaaatatatgtagtgggttatacattgattcatcttcaggccactgtttttccctaaactacgaaaattcaaggttaggctgctttaattaacatactaaaacttgccttagaaagcttatttctagtttaatgtcatttaattcaatccctgattcacagggcttcaggcaaataactcccgatctccagttattttatctccaaagaggaaaatgccttttaaggggtgcctgtggaacacagtggcacacaggacactggcagggtccatagatccttcttaacattccccgtgtggtcatcactggtcagatgtcagaatccttgatgccagtttttcaaagtagaaatagcaaatgtttgggggataattagatagtaagtctttgctcattcgtcatttcattgtatgcaagttaagtatgtaacatttatttcccatggtgtccttgcccctataggctctctctcactatgactgctgtgctctaggacacactgaagacagccacagtggtcagcagacagggtaaatcagtgagacaggccaggtgtgtgacagcagggagcggtggagatggtggcggtatggaggagcatcatctctcatctcttggatgtctttggggcagtattcaggacactgggagatggcctctggaggaggaacagagagaaatgcaggaaaaggaggggatgggatgcgagacttacttttcattttgtgctctttcatattgtttgaattttaaaaataaacagaatcatttttaaaatgaaatgaaagactctgtagacaatcacatctgatggtataacctgggatgtgtgctacaagagtcctgtccaatacagcagctatccaaaagaaacagaaggcaagctacatctgtaatttttaaattttctagtagccacattaatgaaacaaaacagtgagattaacattaggagtttatttcatgtaacccaatatatccaaaatattatttcaacatgtaatcgatataataattatgaatgaggtgttttatattcatttttcataaatcttggaaatttaatatgtattttatactcaaaacacattacaattcgaactcaccacatttcaatcgcggcatgtggctagtggctgccatactggaagtgcagcctggtcgggtcagtcttccttcccaagctgccctcccttatgcgaacacagctatattaaggagtggccggctgggcagctgctgaggataccaggctctgaggaggcttaaacactccatgaataaattaggcatctaatgccagtaacttatatttgtttcctacccccaaaacagacagatagccctctatctgttgaggtttttttctttttgagtgtgtgattcatattgcaagttttatgggccaaccaccctgggagcagccaagtgacagttgcctgggttggcagttagaatctattgatgttgaaactcagtagtgcatagcttagtgctatttactaggaatacataatgtgtcccattatctaaattataaacctcttaatatctctcctaagaatttggttgaatctgaaaatcatttaaaaaaactgaaaagataaatgacataaaagtgggaaaccttttgttcacaggtatatttgttgggagatgatggaagaattcccaggggctttcatttcactgcttcttcctcctcccaagattacctaatccttgctcccatcttgaaggtcaatcatttattctattcatcaaagctcctagttttgtcagttaatgactatgcatttggtatttcacattgctgtccagttttcaagtatttgcatttctcagtggctctgcaagtgtaatgaacatttgctgtgccgtggaagcaaggcgtagggtcctaaactgatatatagacatcatccacaaccaaaatccaaacaggtctctacccttcaggcacttattattggatttaccactgatgctatttacaactgaagcccttaacaagtgaggtgtgaccatagaaaaagacaccagtttctagaaactgcatgcatcctttctagaagcaagcaaccaaggagactgcattttctaactagagatcatatctagatatactaataataataatccatcaatatcactaccatctacagagctctatatggctgcaactatgcatgcattagcaacttgatccttgccactacctcatgaagtggatatttttattatcaccatttgatgaagaaactgaggctcagtgagggtaaataggccacagatctgtaagtgtaatagataatacatgtgaaagagcccatgcctggtgagctgctgtattggctgtaaggaggagagatgatttttgtccatgggtactggggcatttcctggaggagtaggcatttgaaatgggtgttggagcatgggttattggctctaaggaggagagatgatttgtgtccaggggtacaacaggcatttcccagaggagtgggcatttgaaatgtgtctttgagcacgggtaggatgtaggcatctggagatgcctagaatagggaataaaatcagtgaagacttgggaatgggcaaatataaggcacacaaagggagtggcaattgtcatgagtccagtgttcccagagtgattggaacaggagcagctgcggggaggggtttgcacagaagatcggtgacagtaggtgccaaacacccactgtgtgacagattctttgctagggcttcacatagttctattatttactttccaccaaaatctgtatggtaggaagtattactatctctgagtcacaaataaggaacaccagactctgaggggttaaataacttgctcaggtcatacactagcaagaaaaggagggagaatttgaatgcacatctgtccaaccctttccactgcaaaatgaaacaaatcatgttttaaaaagacacttttccgaggaaataatgtcctgcttttatgctctgccctgtgacaccaattctccagagttgctacatttctatatcgaggcaagcccccactcttggtgcctcctctgtgatgtgcatccccacctccactcccaccgcacctctttcaatggtcttctccctcttgcctggtctttgcctaataggaataaaacataaaaatcaaaacccaagaaaagcccaatgtcatgattatcaagtagctcacagcaccagctaggattttaccttaggggtgagaagatttatattgcaataatcaatatctcagaaatatgtggctcactttctgcaactgacattccatttcatggcttcaaagcaatggttacatcagccagtttgcgtctttaatatagtgaaatgcctactgagggaagtcggtggagcatgtgctgtgggggtggggagtctttattgccatctaatgaccctaaaatcagctctctggttatccagcacgggaaagcaaatggaaccttccatctcatccatgacaaaagtattgagtggttctgaagttatttgtacaattgatccagctaatatcaggaaagcatgttcaccagatgaattagagacaattaaatgcaattctgtgctcctgttttctatacacagaagacaatcataaacccagagggtccaaatgaaatcatctgacccattttaacaccctttccgtcccacattcaccattctagtccactgaaaagcctctcagatttccactcgatgaggtgatttcatggtgcatttctgctatgcaatccccctacctcttttactgtcaatgaacttaaatgctcacagcaaaacttattttcatgagttcctttcagttgcttatatacacacacacacttagcagagtaacctttccttcttctccttcttcacctctgacatacactcattcaacaatttaaagaaattccacctcctaaaaaccctctgtaatctgcccattctctctgtctctgctaatgtatcttattctatccctcatcttattctgacccctcctctctgtcccccagacatggcccaacttaagcccttattttaccatatttcctgaaatatgccataggttgtgaaatatatcctgattttatgaaccaccatgaaagtaaaaaaaaaaaaactctacaaataaaataaaataaaataaaatatgccattgtttgtaggaggcctcctaaagagatgttgaaacatgaaaaaaatgtgcatcttaaatggatgatacacagtatctctatgaaactcttatcattgtctcctgactgctcatgccaacaatcttgtagtggcacaacaggcccttcacaatcaggctctgagctgcatctccttttcctaggcttgcaaagccccttctcatttgtcaagaccacctcctcaaagtcctttgaaaccccacaggcttggtgatgatgcttccctgagttcctatgacttccttaacttaagcgtaataacacataaacatagctttgtaattatctgcccccatgtcccactatgagaaatccttggagaaaaggctatgtgtctccttcacctccatatccccagtccctgacacaggacagggcaggtcctccttgaattgctgaatgcaatggactgtgtgatacatgtagcttctgaacctagtcactagagggcagtgtggaaccatcccattgcccacaactgcggttccccaagaatctaggttgcagaggttgtaggaagctggcctatggctgagagcctaggaggctacatgactccaagggcccagtaccattctgcagaatcgaccctgaggatgctcctagcatctccgtatttcttgccagcctgcccactaggtgctttcaagtggctgcctcagcacatttcttgattaagaaccaaatgctcttcctagctctccacctatagggatgggggcagaggccacagagagggaaataaacgtctccttaacatccccattctcatttctaataaaggcaggcttactgtgaagggcctgcaatataactgctccactttgaagaacaacaggtagcagcatcaatatttgatttttaaaaggttgtgtgaacagttttaaatattaaagataaaggcaaagacttagatcatctttttatctcagcagttgaagattttaaatgaaaaatggtgctaatgagcagaataagactgttcacccatcaaatggtatctggttgcaataaagcaaaatcattttggggttggggggagaaggggtgggaagcaatatctgtaccagagaagttttctgttcattatctctgtaatgagagaaaaataaagccactctgctggagtaactttcttctatctcatcgtgggctgtttagctccctcaatgagtggtctgggacaggctccgagaaacctcataaattaactatccaacttcctggctaatgagcccaatatgtcaatttctagtgatcaaaatgatgcaattcaatacagcacagttcattttgtaaggaaatatactcttaatagagagaactgcagggtcaccgtcttcccaagataattatgggccagagaattagaggcgtggagctgtacttactgtctggagatatcccatggggtttgtgtggcagatattgtctttcagggacaataaattccttcattatatttccattactgcattaatgcagcgatctccattttagttgtaaccaagaaggctggttattcctgaaacttggcatttaatgctaatgagagcttgcaaggcaggcagctccctgtgtgtgtgtgtgtgtgtgtgtgtgtgtgtgtatgtgtgtgtgcatgcatgtgtttagggggggttgggtatagacaatccagcagaaatgtcaagaactagaaggtaccagggagagtctggagggctgagatggctctgaccagacagacagatggatatctggaagagtcaggggtaagtagtctgagagccaagagtaaattacagctgaagagagaagctgagatcactacgaggtaagcagtgccaagtgtgaaatccagcctgagaaagcaggtggtcctgaaggtgaaacaaacagatgcaattcaaaaacaggaatgccgggcagcaaaagggttcaggaatgctcggaagtaagcaatggtgctgtaaactcatcctaattcagggttgcctacgaggtatgagaaaaaaccaggcacttggtggtggagccaaaggcagccctagccaatgatatctctttaaaaggctccagctcaaggtagaccctctaagagcaaggactccatgttcaggcttgctggaattgcttgattctataatctgcaccccaaaataaggtacttatttggttttaaagttagaagtggatgaaaatgaattccacaagtctccatgtgagagctgatgaagctccagcatgctatctaaccatgctggaaggctctgatctggcagggagaaccaggtgggaaatactggtttcactagcatttttcaacttgattccagtggagtggacaggcaacatagtaggagaaaggacagctcctggggtcaggttcaagttctggctcctttgctcttagcttcatggtgttgggcaggttgcttaacttctctgagctgtggtttccttagctgacatttaatttgctgggcaatctatctatttgcagggaagtggggagataaatgaatatgtcagtttgcttatttttgcttatttttatttctccaacaccaaagataagaaaaaataagttataaacagaatcaggattctttcccttgaagcaattcttatctaaaatggactttagtcaggaaagtaaggttgctgttaactcaagtaacttgggaaaataattgtgaaaagaaaaattttccatgaatcagagagctcaaaattataatatgttaattaggaagtgtttacttaaggtgagaagtggattgtgctaagttcaacatcctgccagaggtcctcgataggcaatgactggcaatgcccgttagcttgctccatccttgcaataaaactcattgtccagaagtcttgggaggtgccttggtagagatcagttgctatttaaaaaatctctaactgttgacttttaccttgtcttggccattgactaaatccaactattgtgcactgagtgtttactaactgcaagttcattttaaatgttctctcatttgatctttataataattgcatgaggaggatttaattatgcctgtatttagagatgagaaaactgaggctcagggagtttagcttaatcacatggttagctactaatagaagaagaggggagtttcacactcatacttcattcatcattaggtggatttcatatctcacattatttttagtactcatcctcagtgactctggctttgagcctcttaaatttgtaaaacaaacttgatattttggaataatttcagtaggtctgcagaaaagttgcaaagatagtacacagatttccatatatccctcacccagcttcccctaatgttgacatcttatgtaatcattgtacatttgttacaactaataaggtaatattgtttcaccactatcaactaaaccagtgatcccccacctttttggcatcagggactggttttgtggaagactatttttctagggatctaggggtggggggacagctttgggatgatcgaagcacattacatttattgtgcactttatttctattattattacattgtaacatataatgaaacaattacacaactcatcataatgtaaaagcagtgggagccccgagctttttttttttgcaactagatggtcccatctgggggtgatgggagacagtgacagatcatcagtcattagattctcataaggtggacacaactcaaatctctcacatgcttagttaataatagggttcatgctcttaagagaatctaatgctgccactgatctgacaggaggtagagctcaggcagtaatgtgagcattggggagtggtccatggcctgggggttggggagcgctgaactaaactacagactttatttggatcttaccagttttttcacttatgtctggtttctattccagaatccaagccgggatactacattgcatttagtgactctcagttttaacctgattatttgccacaatttccttcgggaaaagttcggggtagggataaaggctaacattttttgtagcctggatccacataaagatgtgctttttttttttttttcttgtttatcttttattttgcttctggtagcagcagttcttaaaactcatggcacacgacactttcattttggcctgggatcttggcctgcttgtacaatagctgcaaaggtttgggattgagattcagctttcaaaagcgactctccatcactgtcttctttcaaggacaggaaatttcaaatcaactttgggctttaccattcagtgtgccaaacattcctgaagtttctacgattgccaataaataagacattccatcatctttaagacatcaaatcttctgataaattgaatttcataaaatattgctctattgatcttagtgctcaactttcaataaggcaagccagcaagagttgctggctggtactttttctgcaatgaggatgtcatctgcttacatggggagagacatttatgaggccagggttcctgactttaaatttcagttcctggcactatatcaagtccacagtgatgacagttaccttctctccattgctgctgctttaactttatagaaaactttgcttatgcttattaaacaatgtggcacaaaccctgtgaggctacactgcaagtcatgtaagctagtacttggcacatagtgggtatgtgatctctgttaaagctctctttccagctaggacaaaggaaaatcaaacttgtctcaaaactcaattttgagagttcatctcgttttcagaaaggaaagggccaatgatgaaaactgatgacatggcaagactgagaagaaaaaaacacagtatttcttctccacacggtttttccagggctgctcttgaaattgtctgcaatgatgtgcatgtattttttttaattttaaaaacaaataacatttttatacttttataatgacaacatgtcttgaatgccatctgttcttgccatttgttaaggcaactcaatgagaaaacagcattcggatgactaatatttagcctgctcatagtttttaaaatggatggacagattcccttgagattacaccccaggatccatggcaagctggtggggtgggagagctgaaggtggagtttttgccactactgggcacactgggtcactcacccagcatttcttaagcaatcacaaggtgccaggcagtgtgctagaactagaaatataatacaaagataaaagagagactcatctctcttgtggggactgaggagtaaatacacaattctgtacaaaatggtaagtgctaagacagaggtttgcaaagggacgtagtgaaatatgtagaggaagttaatgactcacaccgtgtgtgtgtatttgggggtgatggggagtgggttaaagggtactcagaaacatttctgggaaggaaataaaaccctgacatcagtctagcagaattggtagacatcagctatatgtaaaagggggtggattcaggctcacataaatcctatgagaccagcacagtgcatcaaagatatatttccagtcatccttctgtttgaactagaccagagaaaaagtgtattcaatatagctagtgagttaaacactacttcctgggcactcaccagtgcatcctaaaacggttgatcaacatgaattgattgttcagccccagaccaggtaaagaggggatataagagaagccaacgtggttgatgatgggagggcagccgcaattcagccacaggcaatgatcaaatagcaatgtggggcagtgtgtaaatatgggggtccatttatgctcaagaaatgggtgcatcctctgttactctgaggccataaagttgctactctgagtcttttttaggccagttgctggaggatctggtgtagaaaggctagacaggaaggagatctaggaggcttcctcccaaatctaagattctatatctctgttgctcttttataggactgaggttaaaccttttaaaaatagcctctgtagttttttttttttccctagagctatttgggtgtgcctgtctgtttttaattcataagaatgcacagtagctgcacattgtaaaatgcattcctgacaccctccccgccccgcccagaaataaaaagctttccaggcatgacttctacgttattctctaaatcatagttatctgtggtgaccagcaagttaccaaatatggctataatatcctatgttttctccatatgctatggagaaacaaagaacccctaaacaatgaaaactaaggagacacaaaccctcccccgagaccctaggcttggaggggcacgaaataataccaccattaatactaatatttgctaaactgtattgtgcaaatttgctcaactgtttcctctgtttcctatgtgcaagaccctgtgctgagcacagtatctcactgagtcatcacagtaatcctgtgagctggtactgattgtattaggctgttcttgcattgctatacacaaatacctgaggctgggtaatttataaagaaaagaggtttagttggctcatggttctgcagcttgcagaggaagtgtagcactgtcatcagcttggattctggggaggcctcagggggcctttattcatggtggagggcaaagagggagcaggcatctcacatggccaagtgggagcaagagagagatagtggtgggggaggtgccacacacttttacaaagaccagatctcagccgggcgcagtggctcacgcctgtattcacagcactttgggaggctgaggcaggcagatcacgaggtcaagagatcgagaccatcctggccaacatggtgaaaccccatctctactaaaaatacaaaaattagcctggcgtggtggtgcatgtctgtagtcccagctactcaggaggctgaggcaggagaatcgcttgaacccaggaagcggaggttgcagtgagctgagatcgtaccactgctctccagtctggcgacagagtaagactccgtctcaaaaaaaaaaaaaaaaaaaaaaaaaagaccagatctcctgtgaacccagagtgagagctcactcttcaccaagccattcatgagggatccacccctatgatccaaacacctcccactaggctccatctccaatactggagattatatttcaacgtgagatttggactgggacaaatatccaaactatatcactaatgttacacttgttttatagatgtgaaaaggtgctccttataatggaggatgattgacctgtccaaaatcacagagcaagatggtgataaaatcaggtcaccaagccaggcttgcccagtgctaagacttctccctattatatcacctcccagaattaagacaatggagttttcccatgccacacccagcattgcctactctctgtaatggctatgttgggtctggagactccgattttccatgaaactcagtagtcatacacttggaaatctcaagttctgcctttcccccttttggcatgggtggctgtcccactatgtctcagccttgccacttcttcctaaatctgagaaagtgaatgttagccagccctgactctttcctgttgacttagcaagcactgattgaacttgtacttggaacaatggtttcctaggttctgagtggcagaatggggcaggaggggaggagaccagtgaggcgaggcttgaccaataccaagctggctaacatcaatatggctctttaccattttacagagagtgttcacacactcattctcctatggttcccacacaggaatctctgaagtaggagcaggcatcccatctcacaggtgaggacaaagcctctcacagagtgtatgtgcctcatctgtggccacgtgctctgcagaatcagggttcaattaccatccctgtgatgcctcgtggagtgctctgcattgctgctggaatcctatgtctcctcctacttactttcctctatttcattctcatacatagctgaacctctctgtgcctcactttcctcatctgtatatggggagaacaatagtggctactgttttgttgtgaagattaaataaggtaatacatgtaaagatagttgaaagagtacataacacataataattacttaacaaacattaggtactcatagttactattaacaattactagtattaccattactgctgatactatgatgcacacacaagtaacaattataaagatatatgcaaataaatgcaaatgagtatatgcacttgcttattattttacaatgaaagtgctgaatgatacgaagcaaaaaaaagtgatataaaataagatttcctaaacttggctgtttttgatatatatatatccctaacatttcatgtttcagtaattaaggccatgaagagaactaaaatattgactaaatcctggaggaatttccaaatgggaatgatggaaagacagacacagagacaggccagccaccacagccaccaggttaaaatgagggaaggcctacaattgccatgggaacagagaagacaaggagagggaaaagagagaagcatttttttttttttgaactaggccagctaacacagttatgtaacttaattgtcataactgtcatgtgagatacatggtattagcctcattttacaaatgtggaaattgagactcaagttcaagtaccttgttgaagtcacaaaatgaaatggaattttaacagacttttactctaaaacccatgctttctctacctctctaccaccaacagaagcttctggggagcacctcgggagacagccttttgatgtctcccttctctgggctcttagagcacttagcatctctgtaattcatgcacacaacactcacacacagcatgcattgctttatgtgcacaccagcaagtgatccctaccaccaggccataagctccttcaagacagagtcagcatcttagttgcttttctatttcctacctgactaacatattgacttgtacatggtaagtatctgttgagtaacctagtagagaagagagattctatgatataaaagactgaggagaatgcaaaagctttcataatcaaaggttgctcagtgtgtagaacattctggaagccaggttggagtgatacattcccaaccctggttatagaggactgactcaagtatggatcctttactgcagctgagctgctcagataattgtctttcttatttgggactaggactagggagattacatctggggtagtctcttagagacaggggatgtaaactgaggctttgtgggctagtcatctcctgtctgagaagcagagagaaggatgaagtagacattcagtaggaagacaccctcagagcctggtggagaagttgctagatttctgcaggattatcatcatggaaaggatctcactgggcctttgaagccagattgctcaggtctaaatcttggttctgctccttataatcagtgtgaccacgggaaaactgtttaaccagcccatgcctcagtttacccctctgtgaaataaagatgagaataccttcctcagggtgccatgtcatgtgcttcagcacagtgctggatgcataatacaacttcgatgaactgtagctatcattttaatgttgggcctccatttgattcttttgtgctttccatctgaatgtttcaggcatcttgtatactttttccttcctgctttcagaactctcagaagtccaattgctacttgcaacacaaagcaaatcaagttggctcggttgctggtagacagacctgtctcttcggtggtttctgcctgagcatatttatcagctactagccagaaacacacacctgtattattataagtggcaccccaggtcccagcacatttcaaagcacagactcttctctccttctaaggagaagggcctctgcttctttgttctctttgattctcagggcttcttattaatttggtatagggctggggatattaatgtcctcttgttgtcaagaacattctccaaagtcatgaataatcacgttgtcatgcctgtgtgacttaaaatacaaaaggtgcaatttatgcaagttttaaagttactttttcaaaagagttcaacccatgaagctgtcaggctgtcagaatgtaagcaccaaactagaaccttagcacttacttatgaattttcaaaggactttagcacatttttaattagcttctccccctgcccgcaagcctgcaaaacaatctgtttggctattatattctgtgagtggggtagcaatataatgctagattggtgggaggggtgagtggaaaccttgcttcatttaaggtcttttttttttttgaggtggagtctcgctctgttgcccaaggtggagtgcagcggtgcgatctcagctcactgcaacctccacttcccaggttcaagcaattctcctgcctcagcctccctagtagctgggactacaggcgcacaccaccacatccggctaatttttttttgtatttttagtagagacggggtttcaccgtgttgcctaggctggtctcgaactcctgagatcagggaatccacctgccttggcctcctgaagtactgggattacaggcgtgagctactgtgcccagcccactcaaggtcatcttctaggcttcaaggccatgggccagaaaccagttttttcaagtaatttttatttttattaaaagatagttgaggaaagaaagcaggatgccagccagccagccaagatacatgcagaggtttttaatacatacatcctatagttacgcaccatttctccaagcacttataagtaccccaattcacctgaccctcccaacagtgccatttattcccctcctcttacagatgggtaagcaggttcccaggccttgggagaccattgttccccatacctcctgactcatgacaagggactgttcccagagaaacacttctggactctctgccccattctcactcctctaaagggggaggggcatacttctgagactggtgacttgagtgaaaggactgggcctgtgaagctcagtgccatgctatctgctctgaaaggcctgctcacagagagggcacagtctggtttactctcttggctgtgctgggacttcagtggtaaagacctgtcctcactgaggtcagcctgatggtttagggtaagtttaatttggggtgatggtgtggacaatgctctcaaattcactttgcagcatatgttagctggatcccctacacagttttcatcatccataaagctaacgttttggctttcacctgactcctgggtctttctcttaatttaagccatgcagggtacaaggggggtgggtagggaatgttatttactatagccatctccaacacaagtaagaatctattgtaaatagcaaagctgttcttttatttattccacacatatttattgtgtatctactatgtgtcagggcccaggttttaaataagagtcctcatcaagtatgtattttagtggtggagaaaggcatttaacaatgaaatgcacaattacatggcaataaggacaaagcaaagaagcgtgggatgctgggagaatgtctaacagggagcacgacatagtcttgtctggaagttgaaggttgttttctctgagcaagtaatatttaaacaggactcagggattagcaggaagaggccaagcagagtatgtatgtggggaagaatgagggatgatctcttcacgtggtacttgggaacctgaagggaggcaggtgtggctgaaacagagaaacagaaggggaatgggacatatggcaagatgcagctggtaaggtaggccaattgtgcaggatcttgtgggtcagattgagaataccctaggtgttttctaaggtctagagaagatcttagaaatgagaagccattgaaagccttaaagcaagagtgagatacactgagatttggctttcacaaaggtcaccctagctgttgtgtaaagaatggattagagctgaggcaggcagatcacctgaggtcaggagtttgataccagcctgaccaacgtggcaaaagcctgtctctactaaaaatacaaaaatttagctgggcatagtggtgcatgagcctgacctggtgtgagtagccccagctactcgggaggctgaggcaggagaatcgcttgaacctgggagatggagattgtagtgggttgagaatgcgccactgcaccccagcctcagcaacgaggtgagactctaagaaaagataaataaatataaaaaataaaattttatagtagccacattaacaaaagaataaaacaggtaaaatcagttttaagaatatagaccatttagctcaatctatcccaaagatgatcatttcaacaggtagtcaaaataaaaattattaatattttacatgcatttttaatacaaagtctccaaaatccagcacatctcaacttgagtaccagattttcttattagtacttgatctgtgtttaaatttcataaaacttgtagttgaaaaaaatattcatacacttaggtcatactaacaaatttgaaagctttccagtaactgaactgagtatctgtttttcaatttaaattagtccacattaagtaaagttaaaatgtcagttgtttgcactagccccatttcaagacctcagtagtcacatgtagctagtacctacacgtattggacaattcagtcctggagaatctcatctgtgtagcggggcgtgggagtcaggtttttcagacaccaagggccaagaaccgttcctggcactccaggcctgcctgcgattgggcagagcagactctcacagccagaggaagccagaggcagttggtagttaggtagccatagaaccctgatgaaaataaaacccaaagggaatagggaagggatgaatccactgcaagagaattcatgttggaaacagtttatagactgaacaaaatgagaggaaaaaagagagagaaatcaaatatgatttgtaggtttctggcttacaattgtgtgaatagtagtagcatttactgcgataggaaggatgggaggaggccttggtttggaaataaggccattggtttgattctggacatttgagtttagagttcctgtgaaagatccaagtggtgatattgagttggctttgagatgggccagctgagagatcaagaaatatttcaggacagtttagagcttgactaataaaaacaacgtatttcacttgtacacagattttctttaaccaaatgcagatcaaaaatacagtatttgagggatataaaacccacatatatggagggccgatttttttgtacaagagttctgctgagcccactacaggacttgagtatgagcagatttggatagacttagaagtcctggaaccaatcccctgtgtatactgagggacaactataaagggaatgatcagatatgtgtatagtcatcttaaatattatagcatagctcccaggctgggcacaagatgaaacaatggccaaattgcagatattaatatttataggccaggcgcaggggttcacgcctgtaatcccagcacttcgggtggactgcttgagcctaagagctcaagaccagcttgggcaacatggcaagatcttgtctttacaaaaagcaaaaatatttagccaggcgtggtggtatgtacctgtggtccctgctactctggaggctgaggtggaaggattgcttgagcctgggaggttgaggctgtagtgagccataattgtgccactgcactctagcctgggcaacagagcaagaccctgtctctcactgtccataaatattatatatagatacaaataatgtggttattgatggagcctcatctgttgtgaggcaggattggctcacagcactcccctcagtttagatagaaaagatccttcaggaatgtatgttcccctttgctctccgagtccaagtaccttttgttgacaaatgatagtaaagagagctgtcttgggtaaaggacatagtcttcagaaagtgcactctcattctaaataatagcagccttcagatttatgctgtcttcttctgggtgtttgtttaccttgggttagtctttttgggacccatcaactctgaaggtcctgtttcatgggacaaagccgctattgggcacatgaaaagctctccccagactcaactgatggactggagaagcaccagaggcacagctcacagcccttcagacccagcatgctgtggaagtcaagcttggtcagctggccttgcctgtaagcttgctcaggggcatagatcgctatatgagtactcttcagatagctttctaaggataaggccaccgaataggtgatccagatgatgaggtcttacaggatttaacactttgctagtaggttttgttccattaacttagatgggattgcagaaaacacaccttgaccacatggtaatagtcctgatggctgtaaaatcacatctaacacctttacgcagaggaaataattcagtgtcaatcatttgttcaactcaaactggtaaagtgcctacattttcccaggccttgtgcgaggcatgggactcagagatgagcagggcactttctgtttccgaaacaatcagaggagagtatgctagaaggtacaacaaatgcaggggatcccagaaatggggcctctagctcaggctgctcagggaggagaggggtgtttcctggagaaataaactgcttagcggaaactgctgaggaaatagaaacactggagcctcgtgttcttgggtcagagttggacccaggaactcaggcttctacctcctggaaggtgctgacctccatcagccagctgaattagcaccattttatctacagcaagatcaagagagagtctgtggcaggaagtacagagcctggggactgcgaagaaacagaaaactataataatactgaagccctcagaaccagagaaggggacttccagggtgcaacagaacaggtgtttgggagttggcaggttataggcactgttttccctttccaaaaatgggagaaaggtaagtgcctcgagagccctgtggaggggcctggtgtctcggggctccctgtttgttacccctgctctgccctacatcttcccagatggaattctggccacaagttatcaggttgcagatgaatagtgaatactttttttgaatttcatcattcttccccctagaatgactcattacaaattctgcgtccatgtgatgcattaatattgattaagaaacaggtgctctcagattcaattagcaaaactgcaatgattcacacagggttacgctggaaaattgggggaaaatatgcaggtgtgcaaatgagcctaatctgaaggtgctgcagcaggtcttgaaaaatgcatcccctccagcaaatgctttcctggaattaccctttgtttgggtgacaaatggacttgccatttcaaccaaacagtgaccccaaacctctgtggcttaggatccagtggaacttcacatttggagtcagacttctatgtcgggattcccaagctttcctgttgaaccactgcagctgtttgtgaaacacacagcttccttggccccaatctaggtgattcaaattcatggatttaggtgaggaacctgaaaatctgtaccttggaaagtaattcatgtgcctcttgtcatagacaagttagggaatgtgcctcaggagaaggctggaaacttggggctgggaagtgctgcctgcggttggatgatggtgggcacctcagcgacatcagccacccctttctggcttggctttgccatatgtagtatccagaggctatatctctccctgtggatgctgagtgagtagtgttctgatctaacacacataaaacaggaaggaacatcacgatttggcaattaatactttttaacagaaaaaaaactttaaatagattctagagtgtaatcatagacattcaacctggacttctagaacattcttgggcttctttctagcaaaacctcctttgacaacaaaagagagtttgtgacttagatgtcttcctgactgtattttagagtgctaaacttcagtcatagacatcagagtctcatagaatttttagggcagggagggacatttgagataatctagttcaatcctttcatggtgcagaggaaggcatgcaggctcatcaaggtggagagacttgctcagtgctacttgggaggtaagatgagagaactaaagatgagacagcacattttccgagtcttggcttccagctcccagtgcctctttctggccaccacactgtttctgagatcccctcattatttgaccacagtatgctaagaagcagggaaatcagcaaggacttcattttctttccatacatattaagtgagagcccaatatattcaaggaattgagtggcatgatgaggggtaaggatgcaaggtcacatggacacctaaatgaacaactgcaataaaatatgacaaatgcaagagtagaagtacacacggagcagtggcaactcaagagagaaagtgactaactcctcgaaaaattagggacgtcttctcagagggtattgagtcaaaagtcaaatcttattatgtcctggtgaaagaaatggcacacctggcagaaagaacagtgtgagcaagagcctggaggtttcgaattctaaagcaagtgtcagcaaacattttccgtgaagagcaaggaagcaaagatcttaggatttgtggtcatatggcttcaactctgttgtggtagcatgacaacatgtaagtaaatgggcatggcagtgggctaataaaactatttacaaaaggaggcagagagccatatttggccagtgggctgcagtttgttgacactctcttctaaatatgtgtctatcataagtagttcaggatggttggagcatagagcttggggaggaagaactgggagggaaggcgtgacaagatgaatctgatcagcttagtaaggacgagatcaagaagggactccaatggtaaagacatgcttggacaagtcatttatcatctctgagccttacctttctcatctgtaaaatgggaataaaaataattcctgagaaggactgttgtggatattattataatatctgagataaatccagcacagttcttgacatttactgagtgttgtaaaatgttggctgctattcatggcactttctccataattgggatgcatttgaagatggagatgtgggattgtcatgagttcggaaataggctctagaagcaaggtgttttgttttttccagcaggttaaataaggaaaagagatgctatttggccatgagtccagaggggaagtcttcaatggaggctctagatcaaatggcctcttattatctgaactcacttgcattaataatgatgaaaatctacttgttcatttcctccactggactttgagttccttgaaagtggaccaattcatttgtcatctacagaaccagaaacacaataggactcaatgaatggctaataaagatgtctttgtatctgtttctctgtctgcatgtgacacctcccttttcttttcccctttaagtcccacctttatccctatgccatatagactttgctgttagaacaatcatgacatgtaacagtttttgaattcttactatgtgctaggcataatccttaacaatatatgtataccattttatgtcttatataatgaggtaggtattagataacattgagataggtattgttattattcctattttgtagatgaggaaacagggctcagaagatttgctccaaatcttaacagccagtaagtggcaggactgggatttgacttatctgactctcaagcctgagtttgtgcactgtcttccgatgttctaattcattccatgtacattagtctctttccccaatcagactgtttgctgaatattttatttctttcagtacccaacctaatgtggaaaagcagacatttattaaatactcagagacttaatttgaaaagacttttgccccgtggtcatctgaatactccaaagaatgtactactaacttgttctcacctttgggaatcaccaatcttttgtcatatgggaaaaatgaaaatatttttatctgtttatatgctaagcagcattataacagctgcctgaaaatctaggcttcccatccatcacacaagcacctggatgctgtaatcacagatgacaaaccagctcatcagtgaggtctctttgcagaacaggtttgatactagggatcttcatggagaaaacattttctccatcaaaatgaaatgaaggcccactggactagaatcttccttttaacaatggcagatggtatccagcattggttcatttctttctgataagaaaaggccaagcttgcttctttcatctcttcattctccatggagccaggaaaacagaaagaaaagtatgatagatgtgtgtccattttctgattgtccagcgtccaacccccttgaccaagagggatgctgtctctcctccagtgtgtatgatcttggcaggaaagcaattctcaatgcctgtcctccactctggaaacttggagcttagatccttccaatattcctggttcagcagggaggcaggatgttgcatcctgagtatgtgatagcaaatggtggcttggcagacatcagcttgacccagcagtggtagagcagtgatggtagcagtgacgtatcagtgtcactgacagcctcctgaccagcatgtggttgtctctgatgcttgacttcccttgctccaagtctgctcttctaatttcccaccaatctccttccagaaaaatctccattttgcataagacagccagagttgatttctgttgcttgcaaccatgaatgctgagtgacataatatgggaagtagactttttatctacaatcacccagctgactgttgtctaaatagtcatctcttttccctggagttgttttactggctgaagagaaatgatttttttttctttccttcccatatttcagggacaatgataagcagggtaatgcccccaaagcaggaactacattgaaaatgaatacttattgaatggcccattagagaagtatgaaagctcatgttgcttttactcattgctctattctcaaaatgtagaacagtgtttcacacaccctgggtactctgattaatgaattaattacatggtacttattaatggctaaataaaaactcagattttcacatttagtcttcacaacaaatatacaaactagcaaccactgtctacattatacacataaagaaaccaaaccccagcaaggtcaagtcgctttcccattattgctgattaatgttggagttggaattctcagtaaggaccacctaactccaatccaggctttttctattccctatactgaggcaggcaaggagaataagaaagaagaaggaaaaaaagaactgaaaagaaagaaatagagaaaagaaaaggagacaagaaaagaaaaggcagtgaggtgaggtgaaggtctggttggtttaaaggggggtccttttccttggataaatgagaatttccagagtcagttctttctcagatacaaatggcagaagagggtgggctctgttaggtgctgaggttctgcagtgggaccaggaggctgaggttctgaggttcatcctggcccagagagagcaggtgtgagggggccgctgagcagacagcacagcagttcccatacacagctgtgtaggagcaaggctggagagctggcctgctctccatctttagaatctgcctactgggctccttgaaagaggaggggcctgccagggaagtggagtgcagcggggatggtacagggagggaactgcttcacctagcaggcagcactgtgtatatggtacctgaccccccttctctacctctccttgtctaggggttaaatattattattcccattcttcaggcagggaagcaaaccagacagcttcagttacccaaggccaagtgcccattgtgaactctgggagttctcagaggagctggctggaccccatggagctggcaaacccatgtatgtggaggtgacatttatcttctcagccaggaaggagcacgccatccagctgctgcccagagcccaggagaaccctgcagcactgtgattctcattagcctctgaaaggtgtgagggaaacatggaaggcagttatgcctggttttggaaattagggaggtttaatttaaaatatgtcagtttaaaacagctctcatcaaaacctactatggaacactaggacttattctgtctgaatggattttttatccactaaccgacctctgtttatctctgtcttccgccccttcccagcctctggtaattaccattagacactcaacctccatgagaacaactttttctagctcccacacattagtgagaacatgccatatttgtcttttaatataattttttatttttaggttttgtgggtacacagtaggtgtatgtatttatgcagtacaagagatgttttgttacaggcatgcaatgcataacaatcacatcatggagaacggagtatccatcccctcaagcacttatcttttgtgttacaaatgatccaattatactctttatttaaaaatgtatacttcaattattattgactatggtcaccctgttgtgctatcaaatactaggtcttattctttcattctagtttttttgtatcccttaaccatctggaccaccccgaagtcccccactatgcttcccagctttggaaaatgatccttctattctctatctccatgaattcaattgttttgatttttagatcccacaaataagtgagaacatgcaatgtttgtctttccatgcctggcttatttcacttaacataatgatctccagttccacctgtgttgttgccagtgacatgatctcattctttttttatggctgaatagcactccattgtgtatatgtaccacattttttatccattcatctgctgatggacacttaggttgcttccaaatcttggctattgtgaacagagctgttacaaacatgagagtgtagatgtctcttcgatatactgatttcgtggttattaatcccttgtcagaatatataaagagttcaaataactctataggaaaaaatgtaatccaacttaaaaatgagcaaaatatttgaatagacatttctcaaaagaagacatacaaatagtaaatagaaatataaagagttgctcaacatcactgatcatcagagaaatgcaaatcaaaactacagtgagatatcatctcaccccagttaaaaattgcttatatccaaaatacaggcaataacaaacgccagtgaagatgtagagaaaagggaaccctggtacactgttgggaatgtaaattagtacaactactatggagaacagtttggaggttcctcaataaaaaccaaaaatagagtaccctttgttctgttcaactggcctatgtgtctgtttttatgccagtaccatgctgttttggttactagagctcagtagtataatttgatgttaggtattgtgattcctccagttttcttctttttgctcaggagagatttggctattttgggtcttttatggttccatataaatttaaggattattttttctatttctgtaaagaatgccattggtattttaatagggatcacattgaatctgtagattgccttgggcagtatggacattgtaacaatatggagtcttccaatccatgaacatggaatatctttccactttccatttttttggtgtcctcttcagtttctttcatcagtgttttattgttttcgttatagagatctttcacttatttggtatttaaattcctaggtatttaattttatttgtggctattgtaaataagattacttttttgatttctttttcagattgttcattgttggcatatagaaatgctactgatttttgtatgttgattttgtatccttctactttactgattttttaatgcgttctaacatctttgtgtgtctgtgtgtgtgtgtgtgtgtgtgtgtggtctttaggcttttccaaatataaggtcagggaggacgcattggctcgtggctgtaatcccagcactttgggaggctgaggcaggcagatcacttgagcttaggagttcaaggccagcctaggcaacacagtgaaacactgtctctatgaaaaatacaaaaattagacaggcatggtgatgtttgactttaatcccagctatttgggaggctgaagtacaagaatcacttgagtccgggaggcagaggttttagtgagctgagattgtgccactgcactgcagcctgcgtgacagagtgagactctgtctcaaaacaaccaacaaaccaaagatcatatcatctgcaaacaaggataatttgacttcttcctttccaatttggatgccctttatatctttctcttgcctgattgctcttgctaggaattccagtaatatgttgagtaaaaacattgagtactaacatattactcaacatattactgaaaagtgggcattcttgttatgttccagttcttggaggaagggctttcagattttccccattcagtatgatactagatgtgggtctgtcatatatagcttttattatggtgaggtacgttctttctatacctagttttttgaggatttttatcatgaaggaatgttgaattttataaaatgttttttcagcatttttggaaataatcatattgtttttgtccttcattctgttgacatgatgtattatactgattgatttggtaggttgaaccatctttgcatcccagggataatctcacttggccatgatgtatgatctttctaatatactgttgaatttggtttgctaatattttgttgaggatttttgcatcaatattcattagggatatcggcctgcagttgtctttctttgatgtgtctttgtctggttttggtatcagggtaatactggcctcatagaatgaacttggaagtattcccttctccattttttggaattatttgagtaggattcagcagtgaagccaatcaggttccaggcttttactgggagactttcaactatggcttttatcttattacttgttatttgtcttttcagcctttgaatttcttcatgattcaatgttggtaggttgtatgtgtttagggatttttccatttctcctagattatccaacttattagcatatagttgctcatagtagctagtaataatcctttgaatttcactgatatcatggttttttctatttttcttttttttcctttttttttttgagacaccctcctctctgtcacccaggcttgagtgcagtggtacaatctcagctcactgcaacctccacttcccaggctcaagtgattctcctgcctcagcctcccgagtagattggactacaggtgcacaccaccatgcctggctatatttgtgtgtgtgtatttttagtagagatggggtttcaccatgttggtcaggctggtctcgaactcctgacctcaagtgatccacctctgccttccaaagtgctaggattacaggcgtaagccactccccctggcctcagtggtatcagttttaacgtctcctttttcatttctgattttattcggattttctttttttcttagtctgcctagaagtttgtctattttgtttaacttttcaaaaatccaactttttgtttcattgatattttgtattgttttcatttcaatttcatttatttctgctctgttatttattatttcttttcttctactaattttagggttggtttgctcttgcttttctagttctttaagatacatggttaggttgcttatttgaaatttttcttcttttttgatgcaggcacttggagccataaacttccctgttagtactccttttgctgcttttgggtatgttgtgtttccattatcatttgctccaatatttttttcaatttccttctgaatttctttattgatcctctggtcattcagaagcagattgtttaatttccatgtatttgtttagtttctgaaattcctcttgttgttgatttctagttttattctattatgaccagagaagatgcttgatagtatttcaagttttttgaatgttttaagacttgttttgtgtcataacatatggtctaccattgacaatggtccaagtgctgaggaaacaaatgtgtattctgcagccactgggtgaaatgttctgtaaatatctaccatatttgtctttctgtgcctagcttatttcatttaacatgatgacctccatctaaatgtttgagggggtggatatcctaattaccctgattcgatcattacacattggatgcatgtatcaaaatatcacatacactccataaatacgtgcaattattatgtatcagcaaaaataatctttaaaaaacaaacaaacctactgtagagcatttccacagagtcccatatctcctcctttaggatgatttcccttgaacacttcaatggttcttagaaggcaaaagcagcagctttggaagtgaatagacacagattaaagtcctgattctacacagaattatctgtgattctgggcaaagtaatttactcttctgcctcccacaagcctcagtttcctcccctgaaagattgggataaaaacctacctcaatacctctagatagaatgtacacctacagaataactaaataaatccactctttctttcttcctttcctctaacattcaatggcatgtatagtgtttgtcatacaatttaattttcaattacagttttctttctttctttttttgagatagagtctctctcaatcacccaggctggagtgcagtggcgcgatctcagcttggatcactgcagcctctgcctcctgggttcaagcaattctcctgcctcagcctcctgagtagctgggaactacaagcgtgcgccaccacacctggctaatttttgtacttttagtagagagggggtttcaccacgttggtcaggctggtctcgaacttatgacctcaggagatccacccacgctggcctcccacagtgctgggattacaggcgtgagccaccgtgcccggcccaattacagttttctaataagagacatttacatcatggtaatgctttgatgctatatttatttgtaatttattgtgtactaacagattatagctgcagcttatagatgaaagcttagtatttcatcatgagtttcttctatgttccatcaacaaatcctggcaagtagcagcttctccaaggccacctcctttgcatgcaacactctagcacatgctgcatggtttacagctccctgagctcaccacctgctgcctctgagtgtgtgctcatgatactccctcagttttgaagcctgtttctctgcccactcttgcctccactccacctgactaacatatcctcccttccttggggaagccttctctgacctcatcctgtaatggttccctaagcctgtttcacatgccaagtgctcatacacaggtgctcatgacactcacacttagaaactcattttccattttccatgcataggatagtaggtccacctcacctttacccttgtaaggggcctgtgaaacccagcaaatgactctggttcttagccttaggagatattgtggagatggctcactaagggatgaagatcggtgatgtccctagacctcttctctgtatgagtcacattatcttacatcccattaccctaagggccctcccgggagtccacaggttgtgccagcagcagccagctccagccttgctctgctgggtgaagctgggtcagtgtctaacttagtggcctccttggttgctggaaatgggaggagccatcgtgcatcagatgcttggactaaccaagtggggagccaggactcactctgagtggtagctttctaaatctgcaaaaactagagtttccagagccagggaccctggtttaatgtgctgctttgctggagcccgagcctctgatttcccttgttcagctgggcccatgataacttgcctcaatgatgcgaagagaagggaactcagcagatctaatgtgcctgctgctggaacctggctcctgcgtgaaacaggatgacatgcctgttgtagcaactgtcctctgagttgcagttaataaatctctggctgaatggatacgtggttgggattatacctcttgcatttggcaaatccataatgattcaccctcctgacctgtcactttcccagttctagtgagcattcttttctctctgctatttgtctaccttgaacacatttcttttcatgaattcaccaaaaatgaactgcaatttatttgcctgcaaatgcaagcagctgtgagtaccttgagggcagagattccgtctactcatctttacactgggaaaaacaatggaataaaaaatatattggtggccttaagtgtgtgtccagataaacttagtctcaaattcattctgttaccatgacaaggtaagatgagtaggtggatcaattttaaaggttctaccatctgtgcatctcattcatattaacatttgttaacaatgaactaaatgccactttaaagtaatgaccaacatctgtatagtgttttgcagtacatcaccaccttcaatattatctctgttttgggggcatggaaacttattcaggagccaacttgcatggaagcagcacagtatactgcttaagaggatgcactttgaagtgagacagactgaggtttaattccaggcttccccagctacatgacatgtgatttgggacaagttacttgacttgatttagccttagtttctgcatttgtaaaatgagaacgaagatacatacctcaaagcacttttggaaagataagtgagtttatgtaagtacccagaatatagtttgttctctgtgcatggtaatggtaatggtactcttgccacatacctcctagtaaatagaagagctagactaaggtctaggcattccaaatttcatgactcatctattgtaccagtttaatattacctaatagaacagttccccattttaaatttctattcaaaaccaattcatgcaatcaaatgataatataacaaggaatgctcatatttctatcttcatttacaaagttaaaattaatattccatctgtatattcattttgattggaatgcagagtgcctggtgcacagtgggtgttcaactaatgtttgttaaataaaattccctgtgaattctccccttgcaagtgctagacttggtaactgattataacaggagaatatcaacataatttttttggattgcctgaatcaattccattctttctggcccactttagggaaactgtcaatgacgaagaccctaaggaaactcatctgtggtccataaggagatgaatccccatgtctggggcatcatgttcactgtggcgccaccaactcagatgaccagacacaaatgaatttctcatggtactgtggtggaatcagctgttttgagttaactacctaagtgaatgttctatttttcccacttactattcatagaattctttcttttaatagcttttgaagaccctgtaaatcttttcaaatttttgggattaatccacttccactgtgtttccatggaactttgcttgaacctttattttagaacctatgtaattctgatttgtattaaaattctttatgcgtatttctgttctattagatgttaagctcttgacaatagacacttatataatctttgcacagagaaacatgcatgatgggtggggctgggaaggaaggagacaacaagtgagagagaaataaataaagagatgctatattgtgtctactccaagttcaggtattatgccagatgctttatagctatcacaggtaattctcatagaagagaaggatattactttctcggttttaccaaagagaaaacaggcatacagaggctaagcaacttcctccaagcaatgaagacagcaaatggtggagctagaaatagagaccaattctgtttagtttcaaaatccctgttgcttctccatctccatctcaatgttttgcacaagacagaggctcagtaagcattgaaacaagacctgataaactcacttgcaaataggaggtatgtgatcatagctaagcataatcaaatcatttaacagcttcaaagtacttgagcaatagaagattggtggcagcatatgtttgtctgaatacctacattatgaaaaggcaattcagttagatagaaagcaaagacaaaattaatgaattaagcttcatgtagaagcctagccttagttgctagatttgtgcaaaacaatcatcctagcatgctgttaattgttttaaaaaataaatgaaccggtagctattaattacgctttcatacatctgaaaaagaaaagaaaggaaaataagcaccaagatcaacacaaccagtagagaggctggtctgcattatacagtgaggagtcataaatcatgtgtgagtaaactttagagacgatcaatatcttgtttaactcttatgacaactatatagcaatagagcaatattgtttatacagctctttgtcatcttaacattatctcaaattcgcataaatttgtattctccaaaagactatacggtatatattattgcctgcatttcactggagaggaagcagaggttcaagggtgtaagcaacttgcccaaggttggccatatttaatgcaagagcaaagaagagaaatgcagaccgttaaggaactgcttttcttctaagaattttgatggttgtggtgaggtccatggagaaaagttgattactccagtcacattatccctgtctatgctgttccatctttcttctctctctatggccaatgcagaggacccaggatgcctcacatgtgaattcaagaaatggaaaatttcgctttatggtttaacataaacttggggtggaggggaatggggagaatgctgggctatgaacttcttgcactgcctgaatgtcctgacaacttcctttgtatgaatggccattgggggaaaaaatcaaggaaacaaaaaataatatgttatggaaaccatgtggttgcagtttcacatgatgggggtgggtttagggttatttgcttgcccctatcagttagccacatgttgaaaaggaggaaggaccacagactgcaacaaactgaatcaagactggaatgataatccctgacaatctttaatttgctaaaaacttattacattatcacccaagaggctggataccccacagaaaccaggttttgtcctgtgttgaaactgttggctcagatggagggataaaacaaaaagtttgtttggttagaggttgagtgcagagacatttgctgtagcttggtaataaacttgtctcctgcacaatggacagtagaatcgctgaacagctgttgattggtaaattagtatagagacccacatggtatctgtagaggagagacaatttcttttcccttgtgtctttcagacagatgtttggtgttccttgtgctttctttccttaccatctcatttctgacctttctttgtcaactgtgcattcagtgtggggttatcatttacctacctgctgtgcctccatctgccttccaatgcctgagcatgctcagattctggacatccaatgcagtctgatgaggatttgcttttcagagtccttttctctttgtacacaacacatcaaatggcaaatggtgactgtgggacccacctctgcaaagtcaacagatgccaggtaggtgttcggaaaaaagctgaattgaactaggcaggacagatatttgcaaattaaaacaactgctttcctgccagggttttcgttgggtctcgaaaggcccatggagagaagttaattacaccagtcaccttgaatttcttgaatatcacaagagggaaaggtgtgtttttagttggtttctggttccattgtgaacaacaaaaatgagcctgttaacagggcattatgctgcctgcatgctcccatgtatagacaggggtgtaagaactggaaagaaagctgctggaagtgccccttcttcattctaccagtagaaaactgaggtcagagaggctacatgcttggttgaaggtcatatagctaattgtggttgaggtggatgcggagactacgtcattttacccctgggttggcaggtgtcaccccactatattgtattaattttaatttctctgtattgggctgtaagactcctcctcctagtcaactagggttctatttttatttaaaatttaatcatatgatatttactaaataacaccaaagacataaaaccatataagtatcatgtgttatatatctatatatacactacatataacattcaacatcatcaatttccttattctttcaacaaatatttattttgggcctgtgtgcaaagcactggaatagagattgtcagagtttcaaaggtaaatataataaatctacagtggggtgaaaaagttgagaaattaaaaactaaagagtacaacccaggaaatgtagtaattgcagtttaaccaaaggcatttccatgtctgtaaggcaagatacttgaggattttcaaacatgtgaaatcctcactttaaatagggtttattgtaaaatcttagttaactagagggaattatctgggactctcagttgatcagaactgtttttgctagttctgctttgggagaaagagaccacaaagaatgcaggatggcatcaggaaagaggctgggttcacttccagattttccagaagttttaacttctctatggctcagtttcatttactgaaaaaggccaatgtgaagcttcattgtgtgggtgggaggataaaatgtgtgtaaagtacccggcccagagtctgacatacagcccctgcttagtaaatgcttattttcttagatctcatttctaaaaatgcacttcctgaggaccttcctgggcttgatccatactcaaagctgtctctggtgccatctacaccataagataaaacagtgaggaccaacattcgaaatgatggcagcaaggccccaggaactgtagccatctaaacacaattctgttctcactaatgtgttctgattaccaaagaggagcaatggagttacacattttggaagagctttttagccagagaaaaggaaacacatttttggaagggctttttagccagagaaaaggaaacacatttttggaagggcttttggccagagaaaaggaaaaagtatttgccacatagtcaaccagaagatttaatgactcagaatacagtggctacaagaattgtgggtgactgaggttttgttttatattaacagaacaaaggtgcctttggtgcaggtctgtgtttcttggcatcacttcctccaggaggtaaaggacccaagtgcctttactaaaaataatttctcacagatctgtccagtgctgacagagctcagggctgaccccagggaggcacaaggtgacctctgcatggccttcatcctcactcgtggtggtcacagggcatcagtgtcctgggcagttgtaggaaggaataggtgtgagtgtccacatactaatgcttccaaatgtgtcaaatctccctgctttccaaaaatagattttgtgggtagattgaagtgagagagaattcaaagcacaagaaaatcatggcataaaaaaggcacagaaagcagagctattgatcaggagctttattttatagaacggggcttgcagtctggaatgagacagaggtttctagtaaatagcagcagtgagactggaacctgggggtgctgatttttcatccagtgtttttgctgacatctctgtgatgacctggtccttcaccttctttcctaacgccacccgaggacccctaacatggagttagatgttaccgatggaaagcattgtacagagtctgtgttccaatcctgttctttttttttagaggcgaccactgaggcccagaaaaggggaagtgccttgtctgcgatctcatggaagttaatgagaaagcctgacctagatcacctgccctatcatagacccagtgccatttctactgcagtgtgcaaagacttcaaagaaggccagtgtgctcccctcacccccagggattgcaagttcaagtgtcctgtctgcactgtcctgaggccattctaggccattgtgcagagaaatctatattctatggggtgggggagatagggaagagattgagtcaacaaaacagattagtagacctattactccctagtcttagtacttttttaggtaatttgagtaaaactcatgaatcctagagcactttaactttgggttaaatgtaagtccacaacaatagtcacaaaattgtattgctctgggcttctctacctatagttagggtgtctggaactcttcaaatgagggaagtcattctcctaactttaatgtaacatctgtcatttcatcctcttcctctccaactccctgtagtcttgtccattgctaagcccgcttgcatccatgcaaggagccctctactttcacacagaccacccacaaggcctggagaggtcacagcaaagccagctcccacagcaattagagacattggcattttcttctataaactatagaataggtgtctttaaagatgaggataattgttagggtgacctccctaacaattattcagtcattattctcatctttaaaggcctcctttttactgccagaagcatctcatacacacttagatttctagccacagaccatctgccagctgtttctgccagaacagctgcccatcagaaggaagatggaccaagagagcctttgcacagctccagagtgcatctccagcatcagagaggcaggcagccttgtcatgggtagctccagcggttggtggatgacacagccaacttggacatgaaataggcactgagggcattaaagcagcatgaaaaaggatatccagttgtccacacagtacagtgtgctgctgtttctgtggacttcccacggtcaggcttcaaactctatcttgttctaaatcatagcacgcaggcgcatgcgcgcgcacgcacgcgtgcacgcacacacgcacaccccgccctccactaactcatgaggtgacctgacctgaggatcattgaatccagtcgttcttaaacttgactatgcctactgaccatcttgggggcatttagaaatcacagactcccaggccccaccacccctggcatactgaatcagaattatcaagaggtaaacccctccactcccttaaaaagaaaggaagaggccaggcgcagtggctcacacctgtaatcccagcactttgggaagctgaggcaggcggatcacgaggtcaggatttcgagaccagcctgaccaacatggtgaaaccccatctctattaaaaatacaaaaattagccgggcatggtggcatgcgcctgtaatcccagctactcaggctgaggcaggagaattacttgaacctaggaggcagaggttgcagtgagcggagattgcgccactgcacacctgcctgggtgacagagcaaggctccatctcaaaaaaaaaaaaaaaaaaaaaaaaagaacgaaatctatatttgacaagagtagctaatctaccacacatccacgactagcatctaggggctactgatcacagttcaaatatccacccctccctgtagtttttattgaagaggacacagtggctctgggagaggaagtgacttgccttaagcaaagccctgacagaaatgggactacgagactagaaataaatgccttcacctcttttgttttgctccttcgcacaatgcacatgccctgtcccttaatgatggccacagcttccttcctatttttctatattcataatacaacacatggacatttggctgggcaagcacatttattgatcaaaaatatgtaatcctccttccttatagaagctcaggttccttctacgttatttaggtgggcacctcaaggcgctaggaagaccctaaagctttagagatcagcctctgaaaatgtatgaatactgttgtgcatgtgcatctgtgtctgtttcaggcaagaaattctgtaactttcatacatgcccaatggcatttatctacatccctaaaatggctaaaacttctggtttacaatatccctaataagaggctactggtttgaaggagatggtttagaacacacacaaaaaaaatacaaaaataattttacttgagagatgcagcttaagttactcctttttggcacatctaactgtgccaggcatagtgaaaatgattgataaaatgtcaagatagaaaacacgatcataaaagctaatgcagcttgagaatttttttaaattggtttaaagttgcattgtcactagtgggaagcacaagtatggccaacccaaaaggcctcaaggaaaaggcaagagaagtcagagaaggctgaagacgcagacttggagggataataaaacattttatcagggcaggacttgagaggaatataaagcagtaagttttaattaaagttatgctagtacactaatttgggcaaccaagattcataattaaaattttatgccaactctgcgcatcaccaaacatttttaatggctccaggaagaacatgatgtgggtacaggatacattgcagtgaacatcaaggggagccagtcaaatgcacagggtggggaaacagtggggagtagctaggaagttttgtcccacaaactctgaaagctttcttctgaaaaatgggcagtcatagctacttggtcaaaggagtgtccaaatgtcttttgcaacacagcaaagtaccacttgctggtacttttctgctttccccaattcaatatggttcttggaaggcatgaatcacttctttcatctttttatcctcagtatttaagacactgtcttatatcagttatttagttccttaacaatgctgcaaaataaataaccataaacccccagtggcagataacaatttatttagtttataagtctttgaggttctggtgattttagctggatttgctcatgtttctgtggttatctgtaagtcatctaggcagctctgctaaactcactttgtttgctcatctatctggggatttactggctgttggctgatctagcatggtctttgttgggatgatggggcaacttggctctccaccatgaatctcatcctccaacagactcccctgggtacaatatcctaacatttccttggccacagcaagtcatgtggctaagttcagggtcaaaaggagagagtgctaccaaattatgtggcaaagagtatgaaaatagaatacagtaaataattagggcctttgatgaaataagtctcttacatgactagactagggtaaaggctcaataaaagtttgttgcaaaaactgagtatattatccaaagaagatatacaaatgtctcataggcacataaaaagaatggtcacattaataatgatcagggtaaagcaagttaaacccacagtgagatgccatttcattcccactagggtggttgaaataaaaaagtcagatgatgacaagtgttgatgaggatgcggagaaactggaagcctcatagactgcttggagaaatgtatgttggtgcagccactttagaaaacagtttggaagttcctcaaaaagttaagcatagagttaccttttgatacaacacttccactcctaggtatatgcccaagagaaataaaaatgtatgtccacacaaatgttcataacatcattagtcataatagccaaagggtgaaaacaacctggatgttcatcaactgattagtagaaaataaaatgtagtagactcatataatgaaatattattcagacacagaaaggaatgaagtaccggtacatgctacaacatgaatgaaccttgaaaacattacgttaaatgcaggaaaacagacacaaacggctacgtatgattccatttatgtaaaatgtctataataggcaatctatagagctagaaagtagattagtggttgtctaagtctgggtgggtcagagggaaatgggggtgacttctaatgcatttcttaatggagtgattaaaatgtttgaaaattgatcatggtggtggttgcacaactctgtggatgtacaaaaaaaacattaaattatacacctgaaatggaagaattttatggtgtctcaataaaccttctataaaaaaacaagaaccaaatgagataattcctttaaagttactcagcacagtaccttacaaccttggctaagttaaccatacttcataaaatctatgatgctatagattgtaagagacaccattatttaatatacaacaagaaaaacattaccaagttaactatgacagatcatcaattataagacatatcttaattttgaagatgttaaaatatggaaaatgtatattagaatcaatgaattatggcatgtgttgaagaaatagcatctgaagttaaatctattcaactgagtagatctttctgtcttcagattccatttttaggctcagatatctttcctagattaatggattttgggggtatccacctttgactcccagccttcatcaaattcggcaggtgggcccagaagaagtacttgccctctctggtcctacctggtgctctgtcattccccttacagctctatcctaggagtgcctggtctgcctgagaatctcttgtgtttttgtaggcatggatctctgagtgtggaatggacctgcctttccctcagggactggaggtcacttctgcctcccaaacccttcaagcatcttctctctctcctatgatgggatgtgatgaggataaacaaggaaagtgctttgtcgtggcaagagacatctggtccccagtggcagcttccacagagaagagagtgtaaaaccacacacatgttcactttcgtttgggtgaggagtagtcagagctgttgactaacggacaataggatgcatgaaaggtccacccatccaacttgtggtcgtcagtaaatctccagtcgcccttggggactggggagaattattttctccctcttgcaatttacaagtatcatctaggaaagataagacagtagcttcattgttggcaggctgtcatgggctttcttaacagcgtgagtgtgctttctaattttcacactagaggaaaaaaattaaaaaaaaacaggctcttcagttttgtcttccatatacgtgaatcttatatgggctgtagaattgttctgtggggacagacaatgaaaaaaaaaagtgtgatcagataccttcctcagaaacgaaatctagaaagaagagtaagcagtgtggtagatgctgtgtctacatcactacagttctcttccgctggcattttgttctggatgattccaggtgtagagcagaacttcatgaaaattatagtgcagtaagaagaaggcattctagtgccagacaacccatgttttatgatagggatctaacccagtgacaccaggaagtctttgatcatggtgcgtaagttgtgtaattcccatagtggttcttgtatttgacacatgtaagattttctttttgaagtctcaatttcattaccgaagacactgctcagagaacaattactgatagaccccaactgaagaagcttcctgggaaggaggtgcagggtgtggtctagatgcctacagttgggtatcatgactgagagacggcaaatagcattattcttcatctgggttccaagtggtggaaagtgactgcttggcataccctgtgaatgattctgaggctgctttagaacttcaggtggaaagccaactattactgatcatgcctatctatggatttagctagggcttggggtagagttgagttctgcctgttacactatgtctcattaatttcctctcagggagacagtatcctagcagggaatgatttggaatcaggcacacctggtttccatcctggttctgtttttcatcacatgatagtggagcaatttatgtaatctccctgaacttccattttctcatttgccaagtgggaaagagctcactctgccatgcactctccaaaaaggctttgtctaactcatgtgatcttcataaatgcctggcagagtcaatacctggaatctgtagaagaaagacacttttcacatggggaaattctttcccctcaggctagtgccttcagaccgagtctaatgtactctgcaggctctgcttggatcatttgtgcctgatgtctgaaaaaaaaaaaaaaaaaaaaaaacaaccagaagcactccctacatttgagaaaaaggacatctgggaattaatcctgaagttgggaggaaggttgctgagtctggattcagcctgaggggcagatggctagggatgtccccagagtgtccccacctccacttcatgtgcagatgacactgacagctgtggtgaggaagggccttgccatgtccatgccatactcattaagccatgatatctaacagccaacagctctgcaacctgtacctacttccaaggagtcaagctctatctgcttccaggctctgctgaatctgcctgtatttaagtgccccatttctttcccagaagtaataaaacagtcatctcgttgacattaagtgcggagtagcagacagcaagactcatattccaaaatctcaggaccctgccagttatgacaagacactcttctggctacagaattaacatgctactccgggtttaaatggggggattaggctaacacagagcaaaccagtttcttccttattttccctgacatcacttgagatctcccagaaaatggatagttttcaactctctgatttgtgcgcaactaggatcatcttgcaggaaggctgttcaaggagatgggtttggggtttctgccttgagaagctgataaggatggggttttctgcctagcgattactgtagcagaagtggccctaccttccatcctcctgcgatggggcctccttttcctgagcctttactgtcccaaagtagcagcaggactggacagctctgcccacagcatctcccgctcctgcattcctacattccaggcctcagctggagactacactttctccttactccctcttctctccaaatcccggcttctcagtctctctcctagacttgcaatctaatatagccaccaaaaaaatgtctgcctattttgaaatcatggaaaactgttggtttatttctaccttttttgggtggtgtgaaggaataagcaaagaaacactacattttaggaaaaggagaaatgtgtacaatgctgatttttaagttccagctttagtcagtttaggagcataaggctatcctctacgactcagtttgctaattaagtggtgattggaatattaaattttaaagtataatttagtcagacaataattaccagcgaactaattaaatttacttttcaatggttttcactttcaccgcagtgaacctgtaagttactgagctgcaaggaatcgagcatctttccttttgtcagagaagaaaaagcaggcaaagcaatgataatcaaagagtctttcttctacgttgtatttcgtatgaattgtgtagtagttaagtgcataggcccaggagctgagctatttggttcatggtatgacttggatactcactggccgtgtgatcttgaccaagttgctaaacctctctatcccccagtttcttcatattaattagtgtccatctcatagagtcactgtgcataataaattatttattatacagtttatagaatggtgcctggcacatatttaaatggtaaattagtcctatctatgatgatttttaacaatctttgtgctttctaaacttatctccttcaatgtcaagcctattaaaaaatacaaatttctataaattaatctggaggaaaaaagagaacaagaaaagaaagtcattgataacacctgccacacaaaattagccaatcattcataaattttgacctatcactgtccgcatttgtttccaatgcttctctttcatcctcttcacagaatgctgctcgcttactgagctctgagcaagttccatcccatcttgcttaccttgctctccccacaagatcctctcagactagactctccttttatttattgggtcttctcttttgaaactgctccctgtatctcattcatggtcaacttttgacttcaggtcagacattttgttttccccttattgaaataagtctctgtttctattaatatagactcccagtcttcactaagactctgccttagtttccattttcactcttgcagcttgaatagagcaccaaagagaacaaatgaatgtgcttttccaggagaaataaagttacacacatcccactgaaaatggaggagggggcctgaaaactttctagctcatttttactaattaaatacgtatgtgatgctatttatattttattatttagtaacttgtctttgttttattaccttagagaatgcaaaatcaaccataagggttttaaagcatagatttatagcactttctttaaccctctttttgccagaaggtcttaagttccttaattgcaaattttcccactttgagggtggagaactagggaagggagagacagtacttttcctgaactttccattccatattgctgggctcctctgtggggcacctgcatttcctgagtctgaggtctttccacattgccttgcagggttatgtgactgtcttgctgggacgcctggtctcagcggtccctttcagcactgtctgcatgattttcacagaaacatcttagttccagctacgtttgccactctgggcagttgtttggcaagcatgccatgttaacatgccatgttctttcatgtttctgtgccttagtgagggctttccttccatcttccactattctattcattaacttaataaacatattatgcagctactgtgtgctagcgattggggattcaaaggtgattgagtaaaagtctctcccttaagggagattttattataattcctgagaaggacaaatactgagtaaacaattgagtaacgaagacaattacagtgctgtgaaggcaataaccagggtgacaagataaggcagtggttctcagctgtggctatacatcagaatcctttggagaacttccaaacttatgggtgcctgggccccattctcagatcaatcaaatcagaatttctgggaatgaggtccaagttctagtattttaaaaactccccaagaacatttttaaaaacagttttattgaagaataatttacataccataaaattcacccactgtaagtgtacaattcgacagtttttagtaaattgcagaattgtgcaaccatctccatagttcagttttagaacatttccatcacccaaaaagcttcctcccacccatttacagtaactccccactcccacccctgggcaaccactgatcttctttctatagatttgccttttctagacaattcattccccagggagtttttggtgtagtctggattgaggacctttatgactgagcaaatgaggaagacagtggtgaagttagatctgaaggatgagaacaaaccagctgtgcaaacagtgtgtagaagagccctctggcagagggcatagcaaaggctagggcttggaggaaggaaagagcttggcccaggagcagaaaggaggccgctgcacttaatgagcaagggtgagagtagagcaagagtcagggtccagaaccttcagagctttgtggtatggtgaggagcttgagttttctcccaggagcattgggagatcactaaggggttttacatagcagtgtgacatacctcaatcctcatttaaagaattgagcagttttgtagagactatattagagggaggagaaagagggaagcaggaaggtcagttagaagactagttctatgtggctgaattcagttcattctttaaggcctgattaaatgtgacccattttgggaggctttctcagtgttcctacttttgcttccatagagctcaatttacactttcattaaaccaacaattatatgcaatcgttaataatctgtttacatgtctatcataggctatcaactcgtttggtggattgcatggggaaaaacatctcactgaacaagtaaattaatgggaaatacaataaacaaataaaaatgagaaagaaaaaagaattatatgttgtttttccttctatttctagcacttggcactatgcctggtacagtaacaggtgttcaggaaataaatgtttgttgaattgaatgatgcatctcttcaaggatcaagaccatgctttatgttttgaatccccacaacaagaagcataatttaatgtacaaaataggcaatgcataatttcatgttgcatacatgaatctaccttgagactgaattccatcagcacaaggaatataatgtgtgataataatgtatagtattcaaagcactttccttcattggggaaattgttgctgagcacctataagataacaggcattatgttatgtggtgctggctagtacctggtttaacaagatagtaagagttcccttgagagtgactgtggtcttgttgaaggaagctaaggagcaggggatcatgtaacaggcttgaagggaagaaagtcaaatttcattatccccattttacagatgagaaaaccaaggcagattaaagtgcatgtctaaggtattagttgagatgcaaacctgtgccttctgcttccaagttcttttgttggctagtggctcttggaaagaaatgccacgtctgggacacttgggcatttccctgtagaaagcaatggttgtctctaggaggcacaccatggtgaacgcttctgaagcatggaatttgcagctggaggagaccctggagagcatttgctttcgctgctttattttatagataatgaaactgaggcccacagaaatgaaaggactttctttcaggttacacaggtatttagtcagaaggccatgcattctcagagtgaaaagcccttattcattttattgttaaggaaatttagaaccagtgacatgaaatgatttgtctaaaatcacacaactaggaaatggcagaactccaacaagaacttaggtcctctagctcttagatctgttttctcaccactaatttgtagaacacttaaatgcttatatctgttgtccaccaaaagacataaaaatgttcatgccaccttttttaataatagcgcaaaatagaaataacaaaaaccttcctaagtggtagaatgagtgcttacattgcggtatggtgacaacatggaatattacacagcagtgaaaaagaatgaactactgcttcacaaaacaaacatgggtaaatcttaacagatacaatgatgtgcaaaagaagtcagacaaaaaaagagtccagactacatgatttcacttatgtgaaattcaagaacaggcaaaatagtgattgaggtcttaatagtgccagcggctatggctgatggggaacattagtggaaccttgcagggtgctgggaatgttctgtgtctggatctggtggaggtaacataggggtatcaacatggataaaaatctgccaatatatcctcttaagatctgtgtgcatttctaaatgcaagttatacctcaatagatgtaatgaatgaaaaataaagtttccactgtcatatcccattgttctcactacagatctgagaggtaagaccaggtttaagaatattaggcttagggaatttgctgaccaatctcacagcccagggaacatgtcagcctagccataagctctgcttgaaaaagctgctggttttcagtcaattgaagaaaggttttaaagtttcttagagagtttataaatgtgttaattacagtcatcaagattttgtattgcaataaatgtttatctaatgggtttaaattaggcaatttactcaatttgcttgttatttcctaattaacttctgaaatcctctttctctgacttttcaacctataccaatagagtttggatctaagaaattttattttccttttagcagtacgtatagctttttttcctttttcttgtttacccatccaaaagttctacaggcaatttcaaatgtacatctgcatctctgtttcttgaacttttgattttgttttgttttagggcaagactccttgtccctagaaaagcttactgctattatttacaatagaagctaatagaaagcaaataaatgaccaatgacaggaaaggctcaagtgaactataatgcatctgctagatggaatataatgcagccattaaaatacaacaatagcttggaaagtgcctataatattgtaagtggaaaaagcgagcaaaattgtccatatagcatgtctcaactaagcaaaattacacatgtctaaaagtaaagtatactaaatgtcaacaatgattacgtttaggtaggagaactagagtatattgttattttcctacttttctgtatttcccaaatttactttaaagaatatgcactatatttataatttcaaaaatgacatctttgaagacaaacaaaattcattttcaatatctttaaggcttcctttctaaatgtattctgtttttcaaagctattgagtttctcatattactaataactttatagctttaaatcagtaaactgaagtttattaagccctgacttggcatctagatcttctcatagcactatgagacctaaataaaaaaaaaaaatacaatgatgcaaataaaaggaacaaaagtgatagggaaaaaatagaggctaatgtaagaatgaaaacagtttattttgacctattgcttattagacccttgaaatcagttttctcataaacactccctgatgaaggtagatgtgatcattcccattcatttattccacagacatttctaaacacctattatgtgtcaggcactgtgttcaatgctggggttacaaagataagtaacataccaacattgtggctatatgtcatttataccaaaattattatacctaagaaaagtatagccctttatctcaaggaagcttgcccacagaagagatgcaaaaaacagattcagaaaggttaaatgacttgtctctgtcccacagaaggacagtgctagagccaggatttaaattaagatctcttgggctttactaacatgctctttgtagcacatccagcagcttctctgcaacatcctggtatcgaggaccatcatatgatacagacgacggatgctgcaggactgacaaactcctcagtagctggcaaagctttcctgaacaatggaggacctcactgggctttatagtgggtaagatttagatatgtggacatatcggggaagatattaacagcaggcaggtgagaatgaccccatgatcatggtgctggggtgcagaagggaaggatgtgctgggttgaggttgggggtgattttccttcagtgaatcacaactgagtccagtgaattatgtcaaatataatgcaggggctgcaataaggaatgacaaagagctggcctttgattcctcagatattcattaaacatctatatttggttgggggcaaggaatgaagtgatacatataagccatcatccatcttggaagggaaatgggtccataatcagatcatgaggccaaaacatgggacagaatgctgtcatttagctttcagcctcaaattgtcacctctgcagaaagacccggtctgtagtagtcatccagtcatttcccatagaccccaatcttaaatctatacagaatattgatcaacattggttatgtttctcagtttgtcacttttaaacaaaagtgattgcttatctcttttcattagaatataaaatccaagaaagcaggaaccatgtctgtctgatttctagctgaattcttagatcctcaaacaaagcttgaaaaagaaaacattcactaaatatttattgagttaattaagtgatttttttggagcaccaagaagggtttctagcctggacaggaatggggcatggatgtcagagaaggcttcctgcagaaggtggcagtgagatgggccttaaagtatgagcaagttctgtatggaatcagggcaagagcgagagggctgagggaagagaggaagggcattccaaggcacaggcagacaatggtggtgaaacgtgctatgcagaggagctgggaagtgtcaggcaggacttgcctaaagatgcagctcaagaagaagccccggaagcttccattttatttgaaggacaaaggagatcaattggagagtttgtaagtggagatatgacatgatcaaatcagcatttaaaaaaattcagcagtatggaaagacacattagggtgacacaagattggggatgaggttccctgttgagaaaaagtggccccttaccctccaggagctgggctgggactatcagccaggacttgatgcttgcttgatcaaaataaatattttctccaaccacaccagacaaggccactgcaattccaatgggtcaagtcaaaaaacaagatcaccctataataatttctgaacacaggttgggcacagtggcttacgcctgtaatcccagcatggcagattacctgaggtcaggagtttgagaccagcctggccaacatggcgaaaccacgtctgtactgaaaatacaaaaattagccgggcatggtggtgggtgcctgtaatcccagctagtcgggaggctgaggtcggagaatcgctggaacccaggagggagaggttgcagtgagccaaggttgtgccactgcactccagcctggatgacagactccatctcgaaaaaaaaaaaaaaaaaattctgaatgcaaacaaaaagcatgaacatcatccacactataaaaatgaccaaacagtcccctttcttggctaatatgagtggctgatttttttattatactttaagttctagggtacatgtgcacaacgtgcaggtttgatacataggtatacatgtgtcatgttggtttgctgtacccatcaactcatcatttacattaggtatttctcctaatgctatccctactccagccccctcccgacaggccccagtgtgtgatgttccccaccctgtgtccaagtaatctcattgttcagtttccacctatgagtgagaacatgtggtgtttagttctctgtccttgtgatagcttgctgagaatgatggtttccagcttcattcatgtccctgaaaaggacatgaactcatccttttgtatggctgcatagtattccatggtgtatatgtgccacattttcttaatccagtctatcattgatggacatttgggttggttccaagtctttgctattgtgaatagtgccgcaataaacatatgtgtgcatgtgtctttatagtagcatgatttactatgatttattagtaatggtttactaattacagttttaaccctgctgcattcttccagctgtgtagataagatttactaggatatgcaatcttagaactagccccatttcctgacagcacacagtccagagtgaagccctgcttccttgaactgtcctccaaagtatctaaatctgaatcctgtaagtccctcctagcacctcttgctgatatgcctcatgatatctcacactatgcattgtccctcatagaaacagcaatacactcaacctgttcaacagcagatgtgttcctgcctttgtctggaaggcaatggcaccgctaaaaggttgctgcagtcactaatatgcggaagcccacctgtaccagctcatgctgattgccaaatttttaggaattttgcaagccaagtattaaacctagcactactacaaattaagttatataaacttataattgaagacatttaaagatattaaaaacaacggtaatacgtttactaattcttttcataattttacgtttttttctggagtacattagcattggttgcatctatatggtagagatagcataaaatggtgtcctactgtgcatctgtttccaatcccatgtttagtgtcatcatgttgctgtgaaattcaccatagtgaaaatatttacaccactgaaattggcaaacactacaaaccaaggcttctgctgtgctttctccagttgattggtaaacatttactagcaccccactggctacactaatccatggatgttgaggccttgaagaagatattgagagcaaagctggagatctctggatggattcaagaaatgtttaggtgataaggtaattgatggagaaggaaattaattatctaaactcttctcctgccctctggtataaaaagtataagcatcagattttctttgtctaaggagtcctatctttgggcactgagatatccttttgtaatgctgtcctgagtcccacctgctctcaggctgattgcctgtctatggcttgagtacaaggaaaggcaagaaatagctcaggggaggattgctgacagcactcttggagtactgatgagagccatcaggatgaggggacctgcttaaccatctcccaaatagctccccattttcaactaagagaacagtcacaataggtgagccttccttttatgtcagggtctgtttagaaatacacatgatcaggttatttatttactttaaaaagttcaattggcattaaaatttcacttggactaaatcggataatagaagaagcacagagtgaacagaaaaagcacaaggtgaatagaaaagagggtcatagataacagattaaaaattataccaccaggagaggaacaaaagcactgtgctctgaaggaagcagcttcctctagtgatggtatctggcacattaatagtccaggtaattaatggttgtaaaacacttcaaaagcataaagcactgcatcaatgctgagacataattgtgccattatatcagaacgtggagcttcagtactgcacacctacggtgcaggtttttaaattgctgcagtcttggcataaatccgttggcttccatcaggcgctggcctgccccattcacccaggctgctgtaaggggccacgcctgtgcttacatgtgaaataagaagtggtcagcacatgcccctcctcccccatggagcactttcagatgatcaggacctgttcagaactccagtaactcactctcaggtgaccctaaggtcagtgttattttccatggttgtttgcatgtttcacctgaaggtctaggatcattccacctgcttctcttgccttctgtgaagggacctgcccatgagagagagctggagctttagtggattctcgataaagctgtgtgcaattacacagtgagggtgaaagctttcccctccgaatggctccactcccacactagaatcctaatgtcccataggatataccggcttttccaaccactcatgggaagcaggtattataaaaaaaattcctactttgtagataggagaataaaggctcaaaaggtcaagtcaaatgcagagggctcaagcctagctctgaccctaaatctagcactctttcttcaatgtttccaagctctcaggtggcttatgccactgtttaattttctactgccttgtttcctgctacagtcaaaatcataaccatgccaaggacagaacccactgacattgcagagagtgcttttccagagctcagagtgctttggtatttgtcattttaattaatctggtctgtgacttcatttctagctgcatgatcttcggcaagaccttaacctcttggggcctcagttacttcaattgtcacattcattaactcaacattgaagtaaggtgggcaaaattttattagtattaaattattaataaatatgcattaataatgacctcttaaacttttataactcttcagagtttacaaagcactttctcaagtgtcttcttaatctcttcttccaacagctctggaaggtcgctaaggcaaatgttactactccagtgggagtgtgaagaaattgaggcctagaggctccagaggcattttatataaaatgtgttttgggaaaatattagtccctcaagatactctatgaagaaatgtacgagtgggaaatgctatgttgcctacttagaaaaaagggcaaggcaaattaaaggctgttgtaagtcctgcggtaaggaaacctgcttaattttgtttaaatatgtttgctgaaacatataaccatgaaagagaaactgctttctctgaacacctattaatatttcataaaactaggttttctggtgctcctgttccatggaacccttagtataatcaagactaagcaatttgatcaaggtcatgtgcctggcaaaaccagttcttctgtttctgagtcaatgtgaaacattttacagccctctgtccataacaaatttaacaaccttttttgttcagtttcctagctgtttttgctcagtggagctgggcaaccactccaacccccattaaattccacttgttgccaatgaaatgctaagttacctgtactgagcaaatttcacatcactgtgtagctggcccagattctctcttgtctctcttaaacatccggccaaaggtacaggggtgggagttcagggaaaggtgtagtgaaatttctggtgtcttgttggcttttctttctgagttgcgttgaacattccagagacagtactaaacaccaacaattaggtaaagagactaaaacagcagtgctcatctagaagcagctccacccccgcctcctgcctggggacgtttgaaagtatctggggacatttttggctgtcaccccaggtgggtgctactggcatctagtaagcagaggccagggatgatgatgaatgccctatggtacaagggaaagccttctacaacaaagaattatcctgcacaattatcaaaagtgctgatgtgaagaaaccctggactaaaggaagtgagatggtttgggttgcgtgtccaattattgaggcagcttggattactgaagacagcattgttccgttgcctgagagtcagtgttcaagccctgcttcaccagagtgagaaagacttctggggctcactgccacatagttctcctctaattcctggtacagataaaattcatacagtgaactcctccctgcctcttaccatggattggtagagtcctgtcacttagtgcctggcagtgagctgcaggtgaaatgatcaggcccctaagccatccatgagaccttccatccatgctcctttttaccatctgccggtaaaatccaggggagaattctgaaatctgactgagataatgaatcaggagttcttaaacttaagtccctagatccccaagaggtcagtggatactggaatttgagagagaaaaaatgtcctctttaaaaatttatttttaagttttgcaggtacacagtgtgtgtgtgtgtgtgtgtataaaaatatataaatataatgggatacacgagatgttttgatacaggcttgcaatgtgaaataagcacatcatggagaatggcgtatccacctcctcaaacatttatcctttgtgttacaaacaacccaactacactcttgtagttattttaatgtatacaattaaatttttattgaccaaagttaccctgttgtgctatcaaatagtagatcttgttcattctttctaatttttttgtacccattaaccatctccacctccccccggccccctgctaccctttccagcttctggtaatcactcttttactctctgagtttaattgttttgacttttagatcacacaaataagtgaggacatgcaatgtttgtctgtgcctgacttatttcacctcacataatgatcttccattccatccatgttggtgcaattgacaggactgcattatttttcatggctgaatagtactacactatgtatgtgtgccacattttctttatccagtcatctgctgatggacacttaggttgctccaaatcttagctattgtgaacagtgctgcaatagatatgggagtccagatatttcttcaatatactgacttcctttcttttgggtatatacccagcagtgggattgctggatcatatggtagctctgtttttagttttttggaggaacctccaaactgctttccatgaaaaatggcctctttattgtcactaacctctaattgaaagcatttttttcattatgaatgtaagcaccaactattgtagtgttattggtatccacaactaattttctaatacaaatcagaaatacttattacatcaactatctcaaaatattatttttactcatcactactttgtaattatagcagttattggagcagctgaaagatcttgttttataatgcattgatacagaagcacacatattaccatattacaaatttgttgtatattttattcaattacaaacattattcagagaagggtccatagccacaccagactgtcaaagaggaccacggcacaaaaatattgagttgctgctcttggtggaaggagcttggttcctggatgactgcatggagcagagtcctcccttccaccaaagtcctgtcatcccacattgggctatagtataagcaaggaataagcctttcttgtgttatctactgagatattggagatgtttgttaaagccattagcccatcctgactggctgtaattaaccttgccaaaccctttaattgttctgagctttggcttccaaacttgctcttagaaagaatcttatccacacaggatggctgggaggagtaaatgggagaactggtatggaaatgcacaacagatgaagggttttttatggatcatcaagtggggctgctttttccccaagccagaggtcaacaaactaccatccacatgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttttctcctgtaagtgatggtggggagggatgcatggcagactctttatgcagataaaaagcctgggaggatgctaccctcctcaggctcagtgggatgcctgaagctgggcacaagggaacacacagcatgcctgccacctacgaacactgggccaactgaatttaaagccagaacctgtagcccctttgtcacttgcttgaactagttaactgtatcgatgcatacatgggtttgtttcctttgatgaggtaggccgacatcctcagatctagaaggcatgcatggggcagaagaccaaagctggtttgtcccatatctttgcagtggtacatcccttcatatcggtaggtagcagtgcagaagatatgctcacgcccagtctacagataaggaaactgagtcacagaggggttaagggaatataggaaggaaactaccatataaagacaagcatagtcaaagaatttgcccaccgtggtgtaattagtaagtggcagagctggaattgtaacctagcttgattccatgtccagcagtctatacaacccaacattgctttctccatcattttcactgctgttagtatcatcatctgactgcctttgtgtagtgtatgtgtttgccaagtatagctgtgacaaggctgctgccagaatggtctttcaagtgatacaagtcaacccttgtttatctctgctgttgaattgctgtgtgatcctaagtaagtcacttaacctctctgagcctcactccattcaactgtcacgacagaattgtaatccttatcttacctcactttgtaattgggaactcatttaaataagaaaggaaataagttagctgagtaaatctttcttttttaagtctgcactaaaagaaagttatttttctttgcaatattcacaaaactgacagctgccaaaattagcatctgactctttttatttaagtatatcttatttgcttgtattaccgcagcacatcgtagaatgatgtcctaaatgcccttccaacgctggcattacatctttctaaaccaacccttcttttagctgttgaagaaacaagcatctagggaggcaaaaggatttgctttgtgcctcctaggaagtatgagctgagactagaactctgatccttggttcctagggccctgtgttctccacactacttcactgactcctgaaggagggatcgctttcgtgatgatggttctctgagtgcagaagtcacacctaatgtgttccttttctttcagggtagatgtgcaacattaaattcaccagctttggcttcagaaagacctgggtttccatggtgcctctgccactgacaaaccatgggatattgggctcttttatttccctcctgcagattcttagcttctccatgtgtaaaacaagaataataatagcccttacctcacgggtgtcaagaggttaagtaagatgatgtggataaagcatgtaatgaagtccctggcatgtagtaacactataaatgcagctgttatcatagttactgttttagctgcccaacataaggctcccacatcaaaagcctcctttgtacaatttactcatggggcaggaaagaggctgtgatgtatcatcctgaggtccataaaaaggatgctaaaaaaacaagtcataagcaaccatggctatctgcccagttttataattgagaaaaacagcatcttagaaaatcactgctagtttaggtctcttgcttggaattactaaatgtgaatttaaatatgtatttattttgtgtgctggtgtcagcaagtgtgggtactgaggaaaccatccatatacactttaaacttcctgagttagatctcttgtggatgccttctttctggtcaagcgttggtattggccacttgatttaatctgcacttggggcagcctccttcctggccacagagctgatcctcaccttggtggctcccgagatccatggcaccacaaacccttactatgagatgtcttgaagcattaagctttgatgaaattatgcccaggaaacaggcctcttagccactgacagaggtcacaggctcgctggcttacacaaaaccaagctcttggcagagccctgcagggatgggagctgtttggggctaattagcctcattaagaaactgctgatgagctaatggaactgaaatgtggtcaccttctgaagtcacctagcagatttgcagcctaaaaataaagtaactttccagcagtttcccaaggccccaaagcctgtgctcatatttcttctaagaggaagtagtgcaggtgggattctctttccagctgggccagagcctagaacacggaggggcttccagtccagtgaataactctcccctctcttcctgttgcctccagactcagcctccagagctctactcaaatcctgctccctactgggaaatgtatgctctctgtctctgtctttctctccctctgtttctcgatttctctgtctctgtctgcctgttcctctttgtttatccccctctctgtctctccctttgtctctgtctctgtctgtccttgtttgagggtttactctgtgctgagttcccatatacattttctcacttaatcattataagaacctgatgaggctgttactgccattgttcctgtaatgtagatgaggcacagagaggttaaatgacttgtcccaagttccacagcttgcaagttgccagaatttgaacccaagaagtctgactccagaacatgaacctgagcgccgcccccccccccccaggtaatacccccttcaactgtgagttcttagaatgttgtttgcacctacacaatttcccactccaatgcgttcttttcttgtgcatgtacagtgaacctccccaactgacacacagtgggtattcagtcaatgtttgtcggatgactcatggggtataatcttctgaaggcaatgaacttgttttataaacctggggattcccctacccccccccccccgcccgccgattttcctgtacaaagttaagctcctagtttgaacctgttctctctttctatcagatagtctttttattgagaaagttctttctcatgtctagatgaaatctctgacgcacaaacccatttcctgtattctgaatcatatttgaaaatttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatctactcatttagagcacgtcccagaattagtgtgagggttatgttagataatacattgcatctaacttgtacatcagttattattcttaccacaaactggatgcagaagtgtttctttttggtagaataactgagcagtgatttattttggatagcaaatccagtagaaatcttgaggattgttaccccaggtggaactccttagtagaagagctgtagctgattaatttcttcaaagatccatgctccctccctcccttaattcctccctccctccctccctccctccctccctccctccctctctcccttccttcctccctccctccctcccttccttccttccttcctttccttcctcccttccctccctccctccctcccaatatttattgtgcaatgccaggtactagatgctaagtgctggatattcaggtgctagatgctgggtagatgaaaccaaatgaaaaagctccttcccttcatgggagcccacagttaaaaaggaaatagagacaggtgaatccctaaccaccttgaagtaggccaagtgccatggacaggtggaaagagggaaagtcaatattgaacgaccatccactaaaccttggaatcatcactgactcctcagtttctcttatatcttgcagtccatctatctgcaaatcatgccagctttactctcaaatacatcatgaatctgatcatttgtcgtctccccgcagctgctcccttggtccaaatgattaccagctctccccagaactaatttgaatagcctcctaattggctttcctgcttttacattcactcccatccagtctagtctacatccaggggtcaggaagaacttgtaaaaactgaagtcagaacatgtcactcctctgctcagagctcctcagtggcttctcatttcactcagtgtaaaatctgaagtcctcacaaggttctggataatctggtcctggatactctctgctctctaccttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatgacctgtggtcacccctttccagcccagcccacacacatcagcctccttgcttggccctgatgacttccagcacacactcacctgagagtttttacagagactttgacaccaatcctggcctagactatcctttctacagatatacacatagatcatccctcactttctttaggcctttgctcatatctcatattaaaaaccccatccttggccaggtgtggtggctcacacctgtaatccaagcagtttgggaggctgaggcaggcagatcacctgaggtcaccacaactagcctggccaacattgaaaactctgtctctactaataatacaaaaattagctgggtgtggtggcgtgtgcctgtaatcccagctactcaggaggctgagacacgagaatagctcgaactgggagggagaggttgcatgagccaggatccaccactgcactccagcctgggtgacagagcaagactttgtctcaaaaaaacaaaacaaaaacaaaaacaaaaacaaaaaaacaaacaaaaaacaaaaaaaccatccttgaccacactcactcattattactacctgcattctcccattattactactctcctgcttaatttttctggacatatataaattgtttaggtgtttactgtccttcactccattagaatggaatctggtttggttcagtatttctagtaactgtaacagtgtctggcacatagtaggtactcaataaatgtaagtaggaagaatgtgtagcatggtgcactagagacacataaaagggggcatctaactggacttggtcatgggtccctcttggaaatctgctctaggttttgaagaattgaaaggtgttaggcaggcagaaaaggagggaagaaggtatttgatggggggtccaaatatcatgtgagaagactcaaacgaatgaaaggtcatgattcatttgtgaaatttttggtgcttctagatggaatgacagccagaatccttctacaatggcctaaggaggagacacagccttactcaactgccctcccccacccacttttgctgcttaataatccactagaggttttatcaacagagagattttaaacatttccccaagccctgccttttctaacctgggcagcgctttatttatttacttattttacttttgttttcctttttgtgttttctctgatttttaacagacatcgaaagtccagatgaagaagagggatctttcctttctttacatgttgctgtgctgaaagccaacagccaggaaaggagttagcgaaatgcccaggcggtcacatcagaacctcagcaaagggccacatggctgggccaggacagatcagcagactccaggaagccacggtgggtgtatgcactcaagtcactgcagttcagagtaaggagcagccctccagttccagccaagggcgacggctttgctggtgtcctctactcgtggttggacgctgctttggaaaggaatcatgttcactttggataccaactgccaaggggctgctttccagttctgcccatcatttttactctcttctgcatatctgggttctcctctgttctctcgggaaggaacaggatgaagcctagttgtgctcactgtagagggagaacagggtggaacttttctgattactccattttccaggtctcagagccagagaccttcatgctcccacagctgaaccagtggatgatgacaactcttaagacttgaacactgtgtctgtgcagttagtgctcttagtggtagaattgttagaactgcccagagttctggagtttcagcttcataggtagcagcatagccatgtctgtgggtcccaacctgtcattccaaacttttctttttctagctagagcaacataaatcatttattaagtaattaggctatgttaggcattgtgacacattagacataactgtctcacttattcctctttataacctttctcaaagcttgtccttctttcttacccctctctgctgccatcactgtcactccaccctggtttatttttcttctaagcatttaccataactaggctacatgatatttcatattatttttactgatcattgctctctcaaactaagatgaaaacatcataacaatagagatgttttgttttgttaacttatattgcctatgcctcaataacataataggtgctcaataaatatttgttggtagatgaatgaacatatgagttaggtttcatggctcttttactgagaaataaaccaaacgtttaaaaaggagataaattacccatggtaacgtattcaggatgtggctgggatcagatctgagccaggatttaagcttgtgccagatgagttcaaagatctcatttaatacatcccttcaggtagtttacactctagcagggccagggattggctggtgtggggaagagaggcacccatctccctgcacaatttcaaaaggcaccaacattcaataatcaaaataaataacattgtaatgtacttaaaataaataacttgcaacgtgcttaaaataacttgtaatgtacttaaaaattcagaagttttaatgccaaaaaccctaggatgaacaaaactttaaaactttaaataaaggcaagatcagtcttattgatttttcccttttgcctcagacttcaatatggctcagaccagcactgatctcatccttgtttaaaacgataacaccctgaccccagccctgcactctaatcatagttatgcgttgaatcttttattctttgggcatttcctccctccaggcctttgggcaactgctcctagactttgggatatcggcctcttgaaatatgtgcacgtttgtgtgttttatctatattcttaaactatggtggactgatcatataccactgtgtgacatctctcactgttgcttcataaattctgacttcctcactttactaagcaatggccatttgcaggcgtggccttggcagcggtgctggctagccgctggttcggtttgttagtaccactgtctatactgcctgctgtttaactttcggatcattttgttgcattttctttattatttagtgatcatgagtggaaaacaaaaatgaaagagctgaatctagcaagaggaagcgtaagtctgccaatctaatctaataggaacaaaaatggaaatcattagccatgtcaaaacaatgctttctcagctcaatcagagcctcgctgcattttcctgttgactgtgtgtccacatgtgtaagaaaagaagaggattaaagaatgcataaaactgctgaaggtatattatcgaaaactgtgtcaaaagctgaagttaaattaggctttgatgcttttttccttcttttttttttaactctgctgggaccatctttgtaacattattaaaattattaatgtagaatatactctttaccaggccctcttctcagcactgctcatgaattaacttatgtaatcccataagaaccctatggggtgtgaaccttgtctgttttatatgtgctgcctattatagatgaaaaagcaggcacagagaggttaagtaacttgcccaaggtcacacagctagtgagcatcagagcacggacttaacccagttagtctgacttcagaattccatcttttgaaccaggaacaccaaacctgttacacaacatgtacatcaactggacttcacatatttcacttttgcacgtttctgttttcaattgcatactcattacatacaaacatagtgtcttgcctatgactctctcccatttttgctcatcctaacctttgccttttctaaggctcagataaaagctacctcttccatgataaaggaaacacaacaaaatgattcgaacgttgcacaacaggcagtatagacggtggctcggacagactgaaccagttgccttccctgatactccaagataggacttctgtatcaatcttagcatgcccatatgcccatagcacttaatttctcaattttctcagcgtactttattgttctttcactctacgcacttataatctgtcttaatacattgtgtgtatttcatctttgcattgtgcaaaatagcaatggtaataactacttgctgaagtgggtacagaggaatggggcctgcccagtagaatggcctttcagctcctgggaggcctgaggtttctgtggattttctatgacctttttatactgcggatggaaattataaagtgctatatacacgtggaagaactgaagtgtactatctactggaaagtgaagcagcaagtgactaatgacaacgtcctttcatggagatgacccttctgggacaccgtcagcaaagttcatcattgacatggtggaaattgcaccaggttggttccgggaaattctgccttcaggttccaacgtgacctttccagctccaacgtgaggaaagcagcttcttcttgtgtaaaatatggataattactcctgctctgtgtacctcacgggctgttgtgacagcaaatgaaagatgatatgaaaggacttcataagctatgaagcaatgaggcagttggaaggtgaccagattttccctgggtggatttaatcatgcttaattcattttccatgcatccttcagagccctgcttgtgtggacattcagagttacccctagctcctgcctccactctttcccacctgtttctcctctgggaggccggcctttagggtcagcagtggctcccttactctcaggctgctagttgggtttggccaatgaggggccctggcaggagactggagtgaggaaggaataagaagccagggtatttattctattgtcctctccctactcagggtctcattggtctggctatgtccctcaactgaggtcactgctgccctcaaggcagccctctctacctagccctctcattcaaatagctaaaggcagtgacagccagtgctggacactgcattctccctgtggtttctctacaccctgcacacacgtttgcaaacagtccctctaccaaactcgcctcaagttctcctaataagtgctatcatttcctactgggaccctcatgattcatctcctcaaggttttactttctttatgaggccttcctagcaaacctggacccagcagacagctactccacctggcactgaactcaaagctctcaccgtttttaccagttttggcaaagtgaataccatggaacattcaatctaatggatagtagtgacataaaaattattttccaatacctttgggagacacaaagttaaacagactatatcactaccacccccttttattttcaatctgcaggacttctcagagcatttcatttgcttttgtgcatactatgcaccactaggagagaaacacgcacacacacacacacacacacatacacacacacatacacacacacacaattaaactgtaagaagcctattataaaatgtatcactaaagatgttaaaatgtgaaaaaatgttggtcttagaattgatggaatatgataacatgtagacattacaagctttcttacttgaggaacactttttggaaagaaaatctcacagaactagagctttagggacatattttggcaaactcttacaccttttactagctaacagcatacacagtgtctatatatttatttcatgattgcattaaagtagctatagatgattaatctcttgctggcaggtaatcgttactagtcccatctttagacatagagttaacacatcctatgggctctgtgagtacttggtggttgaggaggctctgtggcacagactggctagctctttaccaagcctggttctgtttcctcctgtacacaaaatgaactgcatctcccagctttccttaaacttaggtttggccatgggagttctggctaacagaatgtagtcagaaataatgtggaccaccttcaagcctggcccataaaactctcccctttttgttctcttctctcatatgctggcaggatgtcaacacccaggacaaacttggaaaccttgcattgaagatggcagccacttcttcagcctccatctctgaatacatgaacttccactacacccctcttcccattgccactgtttggacttagagtgagcaagaaataaatttctactgtacaaagtcactgagattgtagaattcatctgttactgtgtctggtgttgtacaaactaacacagcctcttgtgactagggagttaggaggtctaagggggtggcctatggctgggcactgcagacagtggttttcgtggaggttatatacagccttggcctcttcaaactcagaacatctatctgcacccagtcttctctctgaagtctcccacatgtcctagctagtctggatattctcttgcccattcttcctgctcctgtgcacataactgtatgcaagcatttgttaaattgctttcatttctctgcatacatgttgatcttcctcctctgaccatgagtttcatggggtcagagaccttaatgtattattgtccctactcttaatgttttatgtggggcttggcattgggtagatactaaaaaaaaaatttactgaatgaacgaattcctaggacttattatagccaaaataaggcatcccaaacttttactttcccacatatttagactacctcccagtaaattccaccattgaaacaaatataaaaactaactcaagacactccaagaggaatcaaagcttcaagaacaacaaacatggaaaacaaaacaatttttatgctcaaactttccagtagggtgctgtcatagctaaatgcattttgttcatggaataaatctttcaaagatttactggtaaacatttatgttgagttgcttcatcttttttgtctttttctcattaataatatgtgaataataaaaatacctcattgatatgaagagttatgttaaaatagtgcatggcacatagccagggctcactaaatgttagctattttcattacatcacaggtgaagagtttcattccgtgattttattaagatgtctggttgttacttaagtcagtaaaccaccccccaaggtcagttccagctcatagcctgtgtttgtatggccctgcaagctgagaatggttgtcatatttttaagggataaaacaaaaaaacaaaggagagcaaaaaaagagcatgcctaaaatatgtactgtttggttgtttacagaaaaacgtttgccaatccttgcctaagggtaacagctcaaagactgcccccatggatgtgtctggaatcctctaagcagcccattgcagcttccctgcagtttcctcctttaatttttaaaatgtttgaaatctttaccaagtccgtagctttggtggctgtaaagattcattatacgtatggattgtccaagctgttacagaaactgaacagtgaggtgctgaggctgtgttccatgggggttcaaaagattacccctgtgacatcttgcaaagacagtgccatgcaaatgaaggcagccatgaggagctacgttgaaaagcttcatgctaatacttaggaaaaggagtcatgagggacgtatgcaattgacaatcagtacagccctctaagcagaaagaccacaaagggaaagagaagggaaagtagcatttacttaggtacctagtatatgccaggcatgtgctagatgccttctttagcatagcagcattttaattctcatacagtccagtgaggtgcttataattatcaccccagtttttcaaacaaggaaactggtttgagcaagttgtttgctcaatcaaggactcattcaaacaggattggagtccaggctaggctgatttataagcccttgttctttcctagaacataaggtgtttcaaactttgttatgaagtttagaagtagcccaacccacagaaagaaaggggtcaatatagacataaatagctcaaaaggccgggcgcggtggctcacgcctgtaatcctagcactatgggagactgaggtaggcagatcacgaggttaagagatcgagaccattctggccaatatggtgaaaccccatctctactaaaaatacaaaaattagccgggtgtgttggcgcatgcctgtcatcccagctacttgggaggctgatgcaggagaatcgcttgaacccgggaggcagaggttgcagtgagctgagattgcgccactgtactccaggctggcaacagagcaagactccatctcaaaaaaaaaaaaaaaaaaaaagaaaaagaaaaaaaagaaaaaagtcaagagagtatttacacataggtgactgagcatgaagagtgcactgggatcccagaaaagtctctgaatgtaggaatggataagattcctgcacagtagaccagggatgcctttttgttctctctctcaatctctttttctctctctctcagatgtacctgatttagaaaaagtattggacttaaaaaaaaaacaaacaatttctgagatccattccagccttacaattctatgcttccatgttttgtagtttctattgtttttattcatgaagagtttatgatcagttgatgccagaaagttgcaactcttgaatgactttaggaattcacctcattaaatggctctgtcacaaccctgagcttgcagggtcagggcccaagtgttccagggatagaaagctggcatttctgcttcagcaaagaggccaacatgcagcctctctgcttacttaacacctgacagaggggagagagagacacgaaacagaatacttgactgacactggcttaaggaatgatgatgtgtttgtgtcatctagtagatatttgccatttgtggctgctccatatcttccccatattttagttaaatctcatattacaagtcctccctgctcaaaaacaggagactagaaaactggtattttcagactccttcacagctagaccacaggcctgaacttgggttctatttttgccattgaaagtaatggcaaaaactgcagttacttttgcaccaacctatatcaatcgaatatacccatgtaagacttggattcatgagtgagcaatgtgagggggtggccatgtgtgggcactcactattctgagattcatcacggaagaggctgctacttcttccaaggagccaagcagagcttccagcattccagcacgtgcagaactggagctgagagcaatagctctgatggtaatgcttgcattgaaacagttcccatggcatggttggacattgttcttgtctctgtagttttaaagcttggctctctctggccctcatggagagtctgcaagtcccctaacatccttttaaattattgttttttaaaatttgaactagccacagtggaagctgtttgcagttcagattcctgactacagtggatgctgttgtttgcaattcagattcttgtcatgtgacaagaagtatggggcaggaataggtgatttcagggttgctgtggtggctcaaagtatcagtaaggattcagcctctatcttcccatgttttgtgagtttactttttatcttaaagttggttgtctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagaccaaccatgctttattacagggggcaaagacattcagattctactattaagaaagaagggagggaaggggttgctagataggcaactgatgcctaccaaaatcccactccaagcttgctccctcgttgacaagatctggcaatgggactccgctcctagaagagggagatttcctagaagattcccattcctgttttccccaggccaacttctaggtgcttcagggccttcagttgaacccattgtcagagagacctgggtttgaatctggctcttccacacccccagtgccacctgggcaagggtttcctcacttctctttcttcatctgtaatgtggggatagcaatagccctgcctcatggattgttgtgaagactgaatgctatagtaacactcaattcctgaacatgataagcaataactattttagaaggaggaggaggaggactagtgtggagtattctgatacatagtccttctagggagggtgactgacaacacatgtatataacccggtaattttagaatagaggtagttgataccatgtgtaaggtgagggtttcctcagacatgtgcttacaggtgtgttgcaaaacaatgttatgtgcatcagcttatttaatctcacataacacctttatacaggtgatgactcaaaggcttaaagatgctcatgatggatctgaaggaagaatctggtaagtgttgggcagaatcactcatccagttatacctgggctctttgcattcaacctcagtacctggaaactgaacaggaatgtcagtagcagattgcctgatgaccatcgaggatttatctggagaaaaaccaggagctttaaggtgattttctttaagtatcagcagcactggcttgtgaagcagcaatttcacatatatgtttagtctccagagattgaagataaggatcacattactggagataaattttgaacaacacaagaaaggacatggggtataagctacgcaacagtgaaatgagtggccttggggagaagtgagtttcctatcactggaggtaatcaagcagcacatcacctatagaggtgatccatgcttcaaatggaggcagggaagtatgggtggaggcttctgaggttcttttcagttctaagatccaaaattctatgagagctacaggcaggtcagcaccagccacacaggagtttctggaatggatggagaggcccttccagctgagaggggtgctgaatttaaagaggccctctggaaccaaacacaggtgtagattcctctgctcttcccttagtgcctctgctgggagaatgacgatgaagtcctccaggtatccaggcttctcccttgagcattagtgagagtagcttgttctgaaaggggagccggctggccattctcactgatggatctcaggaatgtcaccaccctggaggccaggataaaccaatgcatcctgtcctcttgtcaacattctttccctccaacatgacacagattaagagcttattttccaacagcctttgatgcatttttaaacatttaccctcaggattattcctcttgttctcccaacttctagccagctgattaaaattctagctcaattgaaatactctttcaaagtgggccattcagaattaagcaaaaagcactgaacttactagaggtctagcacttttgattaatctttaattaatacttcactttaattttcaatgctacctttaaaacacagagctgtgttcaaaccacaaactcattatcttatcattttgaaaggcaggactgtctgtcagagtataagaaaagggtactgtgtagtagtcttttcctggaagtcagttttgtaaaattttcattgatagacagtagttctgaaatatgtatatatatattagaaagcaaccatcttccaaaagatctaaagaatcagctgggagaaaattatggtaacacagggtaaaataatattgtgctgtgttgacataaattcatctttgttatttatcctgatgattttatctttttattggtgtatcacattgctgaaaatatggtttataatttaatttccactgccaagtacggagaagccactggaggcactgtaatgaggaaagaatagtcatggtacgaccatggaaaaggatgcgaagatgatttatgtaactttcttttcctatttacagtttattaagtcactgtctttttgcaatggccaagtgaaaattaaagcacttcagagaagaacttggggttcagcatcattaggggaagaggaatggatgccttgatgaacttgactatagaaatctatagagcacaacttaatcagccttcaaattgatcttggatgctcaaaagcaggtttaagactgaacaaatctttaatgcatatcctttccctttgaaaagcaacatatgatgcatgcatgagaatgatttagagatttttcccagacttcaattcataaagtaactgcatgtagcactttttgggatttcatgggaaaacaggaaaagaatggacactcttcatggacctgcctccttcctcagattctctgttcatgcccctgaaagacatcatctgtacaatggcaattacttagaagaaagggaagtcgcttgttgtccaaatgatcataataaaatcgagccactaatgttccactttctctttaactgcaggttcagagatgccagcagactccatgctcctgggctggcaaggagctgtgaggatcatgtagcacatgatctcccttccccatgaggagcagaagcttccacatgaggcaggtgacaaagtaataaggctttagtgtcacacaaatgtgactttgaacccatacttctccacttactgtgagtccttgagcacgttgttgaaattagttgagctccagattcctcaactgctaaaaggtgccaattaaacttactttatatggttgtcgagggaattaaagatactcattagtggggactagaggtaatggcaaccatcctagtgtcatgcaaaagcagactttattgggcaaatttatgggcagaggatcagtatgacaattctattcggtcctctgacagacaacggttcccaggagctgagttggccagatatagtgtgaggttgtgctctgggaatgggaccaacccttccctgctactctagctgtatataggaagaatatgagagaattctcaaaaaagcagcaaaagcaatctgaccttgtgccccggctgctcaatggtgttgtagataaacatcttgcaactggacatcagcttctcagggaggtatttattcctagactgatgtcagcccccatttgcaggtagtctaagcccctcccactggaagagttaagagttaaccacagagagcgatacatgctgggtacacaaggtggggcagatgctttcagcagcaggcagcaaggttggcattttagtagaggctatgccttggagtatacggttgagaagagagaccactttcccttgacccatatattttgtgagtcaagatttactttgtggcacttcagcggtggaactgtggcctgctgacaacacagctgtacttcttaaacatcccagctatctatggcttgccactgccattcagcaatcaggctttcctcctctgctacatggtgagttcagtataggcactgaaagcaaactagcagaaggcaaaatgaaattaggtttctaagaaaggcgttgttatctttcgattcaacaaaataaacattcacattgtacctccttggtgccaagaaatggagcaatgggagggggtttaataccagcaacaataattcctaacagttattgagtttgtctgcctccaggcagtgctctaagtactttatgtgttttataaaaaaataacatataacacctgcctttgatttaagtgggaagtcagctacttaaccaacctaataggcagtgctagtgctcagtgccataagagtgtaatagacaaaatgctactgcagcagagaagggttgcaaggaaggtcagagaagatgacatttgagctagaagggtaagaattagccacatagaagaggaatggaaggaagaacatgaataaaggcatgagatggaataaagccatgataatggtgttgatgatgatggtgattaagacccaagggcaaggagaggaaagagaaggaggaacagaaaaaaaaattaaataggatgtaacagatttatactctcagccatcatcaatatacctgtcagtgcaggtttatgtttccatacacacttttcattcatggactgggaagggactgagaagcaaacacaaataggactacaacagtctttgttgacttggccaaaaagcaaggcatcctgtctataggctaaaggttggttctccatttctcactgccattttaggtaaacacactcttaagaaaaactgtcattactcctcttgtgatctttcttccaaagaccccatgaatcctttgtaaatttggtgaggtgctctatgtaaaagcactttgagaaaggtagcaggacccaacgtggaggcaaaggcagtctggtaaagaagtcaggtttctcctttgcagtgagctcacaggatggaggcagccatggccaagctgtctaagggcagaggtaccacagcacaggcacggggcacttgggtaacccaggtctttcccccactcgcctgtggggagcccccacccttccccaccaggtagtaaaggctctgagagaagaaaaagacatgggttcatgcattcgcaaatgcttaacatttgtgaagtgccgaggccaagtgatttggacacctttgttaaggatctctcagtgtatgaggaaaagagacttgtaaaaaaataaccgcatataacatgttgaatgttataaaactgtgatggcacaaaggagggaggcaattgatggggaggggtttgatagggagggtgtgggtacagtaaatactccccaaagaggaatatacttgagtataagagagagaaaggagcttgttatgcgttttaattcttagtgtatatacttacctctttccattggaaggttttacttggcagggcataaggagtaatgaaggagggaaagggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttgggaaggtcagtgaaaagattgaggttagtgctatgtaagctccaagccttcaggaagatcctccaaggaagagatcctgaaggcaaaactgagttagcgggcctttgcacagctttcctttgcaagtccggtgtccagaaaatatgaacctcctcttttagcattatcctggtacctgttataaaagtaggaccttcttctaccaattacagtggggatgacgtgagggctgacatttctgaaggtctaccttttggcaaattagatggatggattaagtacataaaatttcatgtgattctcatgaccacattacgatattgggtatgaaaggctagacccatttcactgatgtctggaaattatggcttagagttacgaaataattatctgaaatgacattggtggtacaagtcaggattggaaaccaggcctcctttattccaaagcatttgtctttcccactatgcaatgtttccctgaaagcattagctggaaccactgcttcatcagagagtgccttttgtttgtgcatgatcaaatgtgaaaatgtaaaatattttatatatgccaagtatacctatatgagggattattatagttatttgtcattatttcagtgctactgaaagctttccattatttttaacttttaaattttatttttgagtcaggtccatgggaggctagatatttggagtttcaaatcagttaattacctaataaaaatgcaatataacatctgctcttcaagttaacatttctcctggtcaagggcaaatttggatgatgaaagcatttgtacattctcagactctgaaatccttacagtgatatttatcaccactgatttaaaaattggagggcaagtgtcttgaagccttttatctttccaacgtgtaattaattaccttgtttaaaactcttatgaagtaggtggtgcaggtattatgatcctcatcttacattcttccactaattcattcattttacaaatatacattaacagatttaaaaaatctaagccccagggagatagctgatttacctctaagtcaacagaagaagcaaatgacagactgaaatcaagattcctggctctgcgttctgaatttagggcatttctactaaaccatcttgcctgagtctcagcattaacctatgtcttttgtatatctatccttgatatcttaatgttctggcatatttcatatttctattgtagaaaagatcctgatggaaccagtagcttctaaatcaacacacatttgcctccaaccccccacctccatgaaaatgtggttcttaggactgctgtagcttcagcaatcctgagaaataaatgtatgaagtggcttgtgcactaactcaactacaggggatgggactgctttaattgccatgaggcgctgaatgcagttaacactcagaggaaaagagccttgtttcttggtttctttgaagactgacaattattttatggaacgacttcatgcattatcaaaacttccatagaaattcaatgagacactgcatagtaaagcaagagcccttcccctttacatagcaaatatctctatatacataccctgtacttctcaaacacaaagaagatcgttggaaaacacacagttatgctcaagggagcctgcagattagttctccagcacctcccatgaccctgctcctgcccttctcatctccacttctcctatcaaagattgaatcactcctactcatctaccatcattgtgccctttatagactctatgaataataaagctattttgttttcattttttattttctttcctacaaaatcgtgtgcttaccaccaaagtcagagattgattttgttttattttcatttgtagtcttgatgtctaacacagtacctagcacaaggcaggcactacacaaaatgtttgctggaagagacacaaatgcataaaatcatggtttccatccttagtcaattgcatgttcattgttaagcaaaagaagcaacaggctttgaacatatccagtgcttccctaccatgtgcagaatgttgtgattaagaaggcactaccttggccgggcacggtggctcatgcctgtaatcccagcactttgggagtccaaggtgggcggatcacgaggtcaggagatcgagaccttcctggctaacacggtgaaaccccgtctctacttaaaatacaaaaaaattagccgggcgtggtggcatgagcctgtagtcccagctgctggggaggctgaggcaggagaatggcatgaacctgggaggcggagcttgcagtgagcccagatcgcaccactgcactccagcctgggtgacagagcaacagagcaagactccttctcaaaaaaaaaaaaaaaaaaaaaaaaaaaaaggaactactttgtagaagaggcagttaaaaacagaaatgaagtaaaaaattcattgattgattcctcagatattaggtaagtactcattctgctccaggtatgaactgataactagacatataaagtaatgacaggggaccctggaggggcttatagcttggtagagagattggcctataatcgactaactaaaataaaccaaaatcctaaatggaaagaagactgaaatataaaattagaaaactttggaagagatgcaaatatagctctggcagaggaatccacatgaaaatcaattccaggaatcagcaacacactgctagtcaatgagcaatgggtctctaacatttagataaagtgttactcggtgtcagacattgttgcaagtttcttccttctattgtatcatttattccttacacttacgctagaaagtaaatactcaactccttttacagataaaaactcgggctcatgtgcataaagtaaatagagtatagtgtttaagtatacctgttttggagtctagcataactagatttgaatattgggtccataacttaactgtgtgaccttgaactaatcatgttacgcctcaggattttcacctgggaaagtggataatgatagtgcccacctcactggtgaggcaggtgaagtatttaatacggaccccactaagtgctatttctttagtttgagagcacactgctagcaaggatcaagatagggtttcacactcaggctttaccacagagctcatgctgtttttactgagtttgttgcctttctgggcaaactggataattgacatgcattcattagatatctgatgtggacaaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctggagagtaggtcttagcttgaggatgggaaggatgatgatttcagttttgaatatattgagtctgagattcccatggatcatacaagtacagaggaaagtacaaatggagaagctatcatctctaggaaactgactatgagcggaaggccaagaagttttgagtatgaaaatacgatatcaaaaccacagtgaaaaaaagtgtggctgtggctacagatatcttaaacaaaacagaccagcattgaaaccaaagcagtaacagaggcagacttcagggagaacaaactcacagtttatcatttaagaaacagaaagcaaaccagagctgagtccctttcatgagacccatgtgcttgctcagaagcagagctgaagtaatattctggaaggctaagtgatgggagtagggagagatggtaacggccttcagttttatcaaccaggtaatcaggatcctgctttcctggagagaaccagtttcttatatgccaagtcccttttgtttacccataagaaagactagctcttttggttccttccattccctttcctacagcagtatgtccagacctcaccctcccacaccacccttaagccttcattcatagttgccatcttcagtccgcatgtcattcacagttgccatcttatgtgactgtgtgtagatacatactgatagttaattttcatagtcccctttcctggtttcatggcctccacacacagctatgacactagtattgtctctaactctggcagcatcttccccagtaaaccagtgtgcaaaagagtgcatcttctttgctagtgacattttactgactggtgctcatggcagtgtttctggtgcacatctggctcctccacaggggaatttccaaggtaagtgtgggaagacaaacctgcaaataaactccaataaataggataaatagcaggatgtatgtacaaggtttcaagagaaattggactagagttcatttcacttcaaagaaaccttggttagtcttcaaaatcaccaagtaaacatgggcagaaactccctccaagcaaagcacacagtatgggttgatttattattttggctactttttcaaaccgctttggcaaaaagagcagaaaacctggacttaaccagcttaaatttatgatttattgtctcccagagcaaggtgtccacaggtcaggaaagctccagggagggtatattaggaccctgactccacttcactgtgaccctgtcttcctttccaagttttgcttcatcagcagttccatgcatcatatccaggcatgccaatgacaagaggaagagaaggggctgtcttttccttctgcctctttttaagaccaaggaactatttcccataaatgctctgacactttctcatttcactggtctgaacaaggtctgtgtgcatagctctaaacccagtcacttataagcagtatgggattcctgtgatagtctgagactatttggaatttgtcccccaagagggatagggtcatgttttctgagagggcctacctgaacaaaatcagtacttcatcaatgaagaagagaaggtcagattttaagtatatagccaacagggtcagctacagttactatctacatataacacttattttttttaaagagaaaaaacaaaaacaatcacaaaggatgctgttagaataggatcaggctcaagaagatacactgattctgggacaaggaactctgcttatggatggcgtgacacaattatagagaaaatctgaagatctaaagaactggctgcctgtgagcaacagctgcagaaatgtaaaaatatatcctgtttatccattaaacactaccgagattgagttgagcactgcaccatgtcagataactctgtgttcactatcagaatgtgtgcagttttagagtgagcagtcattatatgttacatcatgcgcagttttgaaaagtcacggtcactaggtttacttgttggaaacatatccttgtaaaagataaggcatcgttggcatgaaactctctttcacatatacacttacacagagaaatatgtataactgatcatttatttttctttcatattaaaccttttttttttgcttttagtaagagtcatatcaatgaaaatggcaacatttagtctgagaaagttaacagtatatggtatggaacaacacaacctgaccccatatcttcagctggctttcagttttcataaatgaacttctgagagacaactaaaaattcatttctggtgcagaaaaatgtgcagaatgggaactatgcagaatgggttaattccagaagttgaacaaggggaatgcacatatgcaggcttattaagttatgtgcaaatgataagtacagtgaccatctccattgctaaaaattcattgtgaatgtgttgaagttgggattgatggagatactgaagtgatagccaaaattcacccagaaacaagctaaagtgaaggttaaagaaaaacagctgcagaagaaacaaactgtggagacatctccagcagtggaagcaatctgtttttgaagacagcgaggaactccaggcatctagcacattctgaatgggtaaagtcggactggagtgggttgctgtgggaaggagccattctctaaagaaaggtagacagcttctcacggctgggcctctaatgttaggctcagaaaacttactaagttgacaactctctaattacacagcctttgaataaaccgtgacatttataagaaaagacatcctgtcatttatttttgttacactggtttttgccttgcacactggtttaagacttcatgggacttttgaagaacaaattttagacctctgctacagggcaggttaaaatggaatcatccagttgctggttgattttttttcccccacgtgaagtctcccttggaatcaaggtaccagatcttctcttggttatctgaaatgatgtgtgctcatcttcagtgaagaagttcatgactcaaatagatcctagtaatagtgtctaattatatatgccaacctttccctacagcaatatacttcccttcaaagtaattctaatattattactttttttggtattgcattaaagaagatagaaagattttaatgctatctttaggaggatagaagcgtagctgtagaaagaagagaaaaattcagggagttcttattacctggttttcatgattagagtctccacagttgcaaagttttacagaaaagtaaattcacaatagcatgaaaatagtcatcactgaattgaccccttaaaaaatcagtccccattcaaaatcagtctcgacttaccactggaatcttagtcaacatcataactgatctctcaccaatttttataaaatagtcttataaaaatgctctgtaaattgattataaggtaaatttttaaatttcccccagaaatgggagattcatgaagtttaaaaaagtgatgttgaagaactgctggaatcacacgcagaattattgatatgatgatgtgacagaaacattactagatcttatttgaagaagaggaaatttttaaggataatgatagtttaggcttccagaagagaatgccatgaatcccaatagaattagggaatattgataaaatacttgaaatttgtaaaataaccctttttgtgatgttgagaaagtcaaaattaagtaaagaatatgttgtgaaatcatgtaatttttattagaaaaattgtaacaaaagttgaaacatgacaatttatccttcaagaattagtgaatagttatatttattacctgaaatatttttcaaatttaagtaaaatatactaatttttaaataaattttcaatgtaaaatccaagtcaaaatattttcactcatctttaaatgaattttggttttcattttaagataactcacttaaaatagcgttttctaggtatccattgtcattaaataacatggaatgtctgtaaatattcttatctcttttcactgagccatacaacctcacatgagactagaaagtcccagcataacaggtttctggaatggaagtgtaacactgtgcttgaggtagtttcaaaatatgtccacaaaagaggcagagcctaattcccctcttcttgagtgtggcctggacttacgacttagtgctaattaataaaacaaaacagaaatgatggtgggtagagtggattgcatagaaacacccacacccaccgcacaaatttgatgtccatcagaacctcagaatgtgaccttattaagaaatagggtctttgcagatataattagttaagatgaggtcattatggctggccctaatccaatgactggtgctctcagacaaagagatacaccgacagaagacagccatgtgaagatggaggcagatattggaatgatgcatttacaagccaaggaatgccaaggattgatggtggccaccaggaatgaggaagatgcaaggaaggattcctcccctagaaccttcagagggagcacagctctgctgacatcttgattttgaatgtttcacctccagatgtgacagggaatacttttttattgttttaagccaccagtttgtgtcactttgctatggcagccctagaacatcagcacaggagatcacttcaaagactgtgatataaaggcactgcggctttctctgtgctcactctctcttggatctctcactccagtggaagttggctgtcaagtcgtgaagatattctagcagcctgcagagaggccccatggtgaggaactgagccttctgccatggccatgtgagtgagccatcttgaaagtagaccttacttttgtggaaccttgagccagaaccccagtgaagctgcttccaaattcctgatccacagaaactgtgtgaaactaaatattgttttaaaccactgagcattgacgtaatttttatgcatcaataaacaactagtacagtcccctttgttccctcagatccaatttccccaactcaaaagtatactcaaaatgcactcagcattgaacagatccttcttctcctaaggctctgataactttttataactttatttccactccttgtccacctcttttcctgacaggataaaaagtgggcttctttcttgcacagaacgctctgtcatataggcccatcatctctgatatgtgaagattctaaataaagggcgactggcttctgtgaatgagttttattagttttattaccttagatatttcaaacgtgatctgaagtttctcatattcccttgagaaatgctcatggacatgaatgctaacattggcattctacccagtaagctttagaggacattcaagggaattcacatatctatgtgaacagctggtctctggtctccctgatccctcgagagcccagtgagggcagcttgctgctttaacaatttttccagtgaggaagggagaggatacctcaccatggagcagagaaaatggaagcacttacagacataccacaggtctgcaaaggaggcattggccttttgcctgattttacccaaacttatcaagtgcctgccatgcactgggcacaataagttaaaggcccatcattatcaatcaggaaccaccttccaggtgacaactgcatccatccaatgttgaagaaggaaaggtcagagcaggagaggagaagcaaatccatttatacagcagcctcagaactgcaggatcacaccccttgggtgaatagacaagctctgatgactgtctgagtgtggaaaccctgagctggggctgcctatggtcagaaatgccagccaatcttatgtgccccttgttgcacaatgatctaagtgctttacaggtattagccctggaaatcctcataacaatcttaacaggtagcaactgttattatcctcatttcacaagtgaagacactgaggcatagtaagaggcaaagctgagtttaaagctgggcagtctggcttcaggccatgcccctccatattaatctctccatagtcttttgaatgccagcaaaaaggatgttttactctttactacatctgatttggaattttgataaaaatgacatgaggcagaatttcaagccttttaagcaaatcatgcaagtctaatgctgtcgcgcttgctctaccgctgtgggctgatttgtgtctgtgctgggtagatatgttttagaaaagtacatgatgggaggcaggctcagctgttttgcgatcatgccctaaaatggttaggaagccagtggctgacagggatcaatgtagcactgtgaacaagtctaaataaatgttaatgtaatattttgggatgaaattaattaggtgtgctgatagttgcctgatgaggtaggcagatcagtatgatgtggaataatatggacagtttagtgttatataataaacccaaaaccatcctatgacgccctggatgacagctagggaatctctggagctcaacatagattttctttaaatagaggctggtaactaaaagagattctgagtctcacatcagctgcactgcatcagccctctttccttaatctgtggttccaaataattttgtaagtagataaaattctgaacccacccaataataatataaccagacaactaatactgcaatcttccctcttgcagggaaatcgctccagaaggcaaatgaagtagtctcctttttaagcatcctctgcttttctgttaaagtttgtctcattgcaggaatcacagcagcttttgacagcctgggggtggtgaatggacttctggatatttggagaatgccaaaatcctgttatgtctgttattgcagtgtacccttgagtacagtctccccaacttttttcaatatcatggtcacttgggatatgataataacgcatatcatctaattccaaaatgcacttctttgcatgataaaatctcttaagttgggatatatcttacaattgtgagcaccttacaattgctgtcatcttggcagcaggaacatggtacataaaatcatcctgcttcttataatggcaggaatcagtgggatatggtatttgtgcagcatgctggggtaaatgcattaggcttcatctggttggaggcagccttccatgggtctctgtaaccaaagcttctagacagcaccccttggggactgagaagctcaatctctcaggtgcctctgtgattcatctgtaacaactcaggagtgtgtcctgagacttgtctcctcaagtctgagccaccctatctgtgaaacagagatcagaacagcactttccagacgagaccttttggggaccttctgcaactttatgtgcacaaagtacctttcatataatctgacatcaaggaatttcagttactgctattggctttacagagccagggctaggttaaggcaattgaggcattcaccttgggcacaaaatttaagaggtgccaaaatctcagtgattgagataagtaatattttcatgcaatatttttaaaagccaaaatcaatgcaagaaaggatgaaaaaataaaaattttaaacagagacaggatccagctcttcatttggttgatgcatctcattgacttatcctggtcttagtccattcagattctgtcttgaatacttcaaatattgcattaaaatgctatttatcttgattactaagtttttttggtgtccccttaaattttgcacctgaggcttgtgcctcactcctctcacactcatgactctggtgatatttctgatgcatctgatgattgtttctaattgtgcctaaattggtctgatattaactatctgttgactcatatactcattcagcaagcctccaatctgttccaggtgctgtggcaggcaatggagatacacagcactggcctgtggagaatgcacataagcaaacaaacatgtgccatatattctttagggctgtcgtgaatgcatctattcattgattcactccaaaatgttcagcaagcacctcctctgagtgtgcccaatatgagcctgggacaactggagtcacaggaagaaaatagtcactatgtgagtcagtgtttccttacaaaacatttatagtggccggaggcagtcgtgagaaatccttttgaaactaaaaaattgctgtgggcagggcatggtggctcatgcctgcaatcccagtactttgggagggcaaggcaggagaatcacttgagtccaggagttcttgaccagccagggcaaaatcgcgagaccctgtttctaaaataataatacaaatagctagacatggtggtgcatgcctgtggtctcagctactcaggacactgaagcagggggacttcttgagcccaggaggccgaggatgcagtgagctgtgtttgtaccactgcattccagcctgggtgacagaatgagactgactgactgtctatctctgtctctctttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatataaaactaagttttttggagtccttttaaatatatgtagttgtagctagctcacatgcatcacctaccacagtgcctagcacataagatacacttaataaaatgtttgttgaatgaccattcaaataaatggcttcctataagtaagatggagatgacaaggttacactatgcccacctagaacccctttgagtgccttggatgctggagggcttggtgcaacggaaagatctgtgatcagtagatctgaacttgaaacctggcttcaccattcattagctgtgacgaccttggtcaatgtatttaatctttctgcaactatttcctttaataaggtcaatactaccaaatgtgcaggtctttagtgagattatagatctgcaaagtgcttcataaagagtctgcctcatagaagaaacttggtggatgtgcatttctttcttttctattttgtttcagaacttgatggaaggaagtacaggtcagaaaggctgagttaaccccaggcaaaaaccactcgggaaatgggcaatgagatatcacagccgctgtcatgccgagggctgtgaccacaccaagaatgagaccactctctttctttgcatgaataccccataagcaagttgaatatgggatgtgaataattcaagtccatttccacaagacagtcacagaaggattggcttcttcaggaaagatgccaaactggggtctttagaactagcttcccgaagacatgcttcaaggacagggaaatacacatgctgtaagcagggaagtcctgaatgctatggcagagatgcaaattggggctgtgtcatgaaaacaaaagttaaaccataaaatgtcactttacatgcagtttaagagagatctatgagaaataaactttagcaaactgctcacatatatcagtgtattacaggtgcctggaaaagcatttctatgaaaatatgcagcatggcatatgtataaatctgtcctgagttttatggtttcatatacagaatcataatgtatataaagtagaggaacacggagatccagtttactgctttaacccatgctagtcaaatggtcttggaataatccaccgaacttacaaagcagcaaacaagtacactcgccacctagaggaaagccagcagcaaaggcaggtctgtctgcaagcattttgtagagtggcaagtgggtggagaacagaatgagatttcttgaccacttgcaaggggtgaggtctctgtaataggtgaggtctctgctaagcacattacattcattctctcacttcagcctccccataactttatgaggcaggtactactgtctccatttcacggatgggaggaccgacaggcaagcgtttgagttacatgtggaagggcacataggcagcagatattgcactgaaatagaagcctcatgaaagcaagggccttgcacaccactgtatcctcagctcttagaacagcgcccaacacttagtaagttcttggtgcatgtgttgagcaagtgagtgaagttggcaaacctggattcagctgactttttgtctggtttcttcccatagaatctttgcagtgatgacaggaatgaagcagcttatttgtgcagaagagtgaattcatgggagtgcagggacagctgcagcctctgagagggcaggttatggagatcctttgggaattcacagtttaaagggcaagctgccccttcttcccagtgcctgccctgaccatttctgcagaccgcgctgccatactaaattatccctgtgctcacatagtagcttctgaggagcaaagctgcctagcatggagtctagaaagaccaagatgcatgggggtggcagacccagttccaagcctcagcactgtcacttattagctatgtgactttggaggtatcacctaaccctatgaaatgagtacattaatgcccatcttaatatcttctaggctggacaagcttcataggctagatagtactcaactccacagcctgtaacctacgatgcaaacggtggcccctgaagttgttcaacacagcggccctgctcctggatgaggacatgggtacagaggagaaagaaggcacaaacagagccagccaaacctgcattcaaacctcagctctgccattctcaagctgtgccatcttgcctcagtttcctcacccataagtgggaataaaagaaatatgtacctcacgggttgttttgaggatgaaattaattaatacatgtaaagcatttggaaggcatgtagcaggtgaatgagaaatattttattgttattttaaatttatgatataattttactatttttaaaattctgtattgaagcaacttattttagggtcttttcctgaacagatttgaagcttctggaagtcaagggttgtatccacttatccacatatcaccctttgtctagtgatgggcaaatacatggtccttgataaatatttgttgaactaatctgaaccatctgttgtcagataaaatccctagtctctttggccatgtttcctcatgaattactttctcctgcttcaaacattgggaaatttgagccaaacacttaacttgttttagttaaaaggtttagatttcactgaacttcagattttgctaaactttccttccccacttttagttccatcttaaatcctcatattttgaaagaaattaggaaaagctctctatgtggctgttagccagaagtccacacataataaagacttctagttgaaagggcttaaaaaaaatctgctgctcttctcctttgggtcatacaattaagtagaagaaatacaaaggcaacaccttccacccaggacccagccagcatcatgcagcctttaaaccttccagggccagtgttagaatcagggcagaagcacccggtttgtcacttgcaacattcatttgtttgcaagacagtatcagggtggatggacactcagtcatgaccacagcccagttccgttcaaagagatttcagctgcaccgagtcagaggcgaggagattgggcttgtctgtgttctccacactataatgataagtggaggtgatcaattgccagagaaactgcagacaaaaaagcccccattaattttctgaaatatttaggaatttgggtaataattcttgagtagttaatatgtgtcacatatagtactattatagtactactaggcacttgcttatatgttaaatttagtcatcatggcagttaaggtaggcatgatgaaccttcagattacagactcagagaggtaaagtaattttcccaaagtcacacagctgaaatttaaatccaggtctgaatctaaatgtcctatgctgagttaaacacttgggctgtggaatcagaaggatctagatgtaaattctaggtctgcctcttaagagctgtattgtttggaggaacctattaaactttaccaatatcatttctaccacatggtaaaatgagaataagaactccactcacagtgttgttgtcaaggttaagtaacatttggcacctgagtctctcagcacaatgtttgccacaaagtaaacaattaatcatgttcagattacttattactactttttaaatttactactcctacatcatgctacttacataattcagatctctcccattctcttaattcttaagagaaaaatggctttagaaatgtttaatttagaaaccctaatttgtctaagctgttttatttaaatgaaaatgcattctatttagaaataggggggctttatcatatgtccttggaaaaactgaaaggagacaagcggatagctaaatagagcttgagtccactgagagacattaaactgaatgctaatatattattatatatttgctaataaattatatttgttgtttaataaaagagagaatatttttaaagtcccaatgatgatatttaactgcataataaaccccacagaaactgctaatcaggagtggggtgattaaatactgcagtgatctaatgctgaaagccttggcattgccacccggtgtccctgatcctcaggctgttctgcataaggctggacaagggctggtctgtggggcatggcctggagcttgtctgctgtccctgtgctggtcaggggccttgctccatgtgcagggagttctgggtaattagaatgtctgtcccagtgattcctttaagcagatatggcctgcccatattgggaatgccccaaaccccaacagaggcacttgcccatgatgttggacttagcccaggtcacctcttggtgcatttactccaatctgtgcttctttctgctcttggttcctcagttcttcagactcgttagctctttctgtccactgtaggatgccctggtgatatggcttggctctgtgtccccacccaaatctcatctcaaattgtaatctccacgtgtcgcgggagggaggtgaatggatcatgggggcggtttcccccatgctgttcttgtaatagtgagttctcatgagatctgatggttttataagtgtttgactgttcctccttcacatgcttgctcttctgctgccttgcgaagaaggtgtctgcttccccttctgccatgattgtaagtttcctaaggcctccccagccatgtggaactgtgagtcaattaaacctctttcctttataaattacccagtctcagggaagttttttatagcagtgtgaaaacgaatgaatacatctggccttggtgacctgttatacaggcatgctttatgactcagtctctgcacctgctctcagatacacttcagatgtttaccttctggtcctacacttggccacggatgagaggcaccttcatctcgccaagattctcagggaatgatcagccagttggcttgctctacggttttctttctccaccttcctcacgagattactctggccaatgagtggtccctggtgagaaactgaggccaagtcaataggttcacagggcaggggtggcagcagcttcacccctgctggacattgttaatgttcagtgaggtcaggcagtctttggtcatacaggagacctaggattaggtctaggcattgggaagcaatggcagagttgtggctgggaaatatttctccagggaagagtgaaatgcatgtccatgcaatttgtaagttaacagcaggcactcaatctcttgactctattactagtggcatgagtagttttcagggactagttttgtgggtagctcccctttagtctgggaacttggatgaagagatgagatggccgaggagtcacttcctaatgaaagcagcatctgaggaaggtgagttctgcacaagtcatcatgccaggactgtggagggtccctggaaggcagaggcatcaagtcttggttcccctttctctctcctagaagagggtatatggtacaaggcactctaaaggcttctggccacgtggcttatgacctaacagaaggaactggagcatattcaaagcttactgtggtgtccacaggggattaagcaaaccagggaataatgtgatcattcatctttccttagcatttggtgtgtgttgggtctgggtcccagtgctttatccagctcagctcgcttaaacctcgcaactaccttatgctctttttaccccaatttcacagaggagaaaatggaggcacagggagattgagtaactggctccaggtaactccagagtcagtgctctgatgctgcccctcttaccatccatttggttctggggaaggttgagtgcaaaacctgataggaagagaggtggaaagagcaccagttttggatttaaatcaccccgggtgtgcctatggctctgtgtctttctgctttgttacactggcaaaattactttactttggttttcttatctataaaatggaggataacgccagcttgaagagttatgaggaagaggtaaaatagttactgtctcccaccaagcccacagtgcctggtccacaatgagcatttgatatatgttggttcttattactatacagaaaagcactttgtaaaatgtgaactataatagacctttaaaactcacaatagcaagattgtaatatgcaccatccttttaagaaataaagttgagaattaaactatcacacaccattgactataagacccatctcaacttcaatgatgctaaatgcaaaatatagtatagtcgacctaggtgcaaaaaactcaaaaagcatttgagatccccttccaccctaactccagcaagaaaggaaagaaatgcaaagaaacaaagacagaaccagtttcttgaggagcacagtgcctgaaccataaagaaaatgaaaagctacacacagatgttcatccaggccagctttctgctggtaggtaatgcatgaaggcaattaggtgctggctcgtctcttcaacattcatggagctgcagagtttaataacgttgaaatctggtgctacctcaaagtaaaaagaggtaatgatgaaagttgcaattaattccttaaatgaattcttaaaatgtcaaaatttgaactacacaagtaatcagtgtacagaaagtggccacaaggtatagaggaggaaagagtgggggacttggagcctgaagacttttgtcatggtctttgctttcctccctaattgccaacaggatctgaactggctgattcacctttggactcaattaccttatctgtcaatggggggctgaaggagcaaacagtaaggctctttcagctctgagcaggcatgcacctgtgccccgcgcaaatgtgcaagccttaagctgaagagggtattaggaaagtgaactttctaatgtttctagcattcccgacctgtcccctggacaatcctgtctctttgctgccagtgctttctatttgcagaaggactgacatgcttgattaaaatgtctcaagcatatccaatcctaatgtattagatctttctttcctcccatgcaatagcagtggcagaaactctgcattgcaaactcatagtttgtttcccgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacaccaaacttctgcacaaaccagcgtttacttatttatttggtccacaacgaggaggaatacagagctgaatatgccacaattcccatttccagttgattctcacattctcatggggcagaaagacagcttcaagatccctttactacaagctgcttgtgcagagtcctaggatggaggtatgatgaaaggttatctggaggtctgaggaaccccaagttgaatcagggggcttatgaaaggctccaaagcgggggaggtcagatggggctcaacaggctgataaaatggttctacatgtagagaaagaaggaattggtattctaaatgactgacataacataaagtccatggttcaggataatagtccagagtgaacggtggctgaattatggattttacagatgtctgtgtgtacatgtgttacaggagacaaacagggaggttgatcttatcttatatgcagtgcagagcaattcatttgttttgaggaggaaagtgataccacaattacataaatcaaggatttaaaacattatcatcatccaaacaaatggaaaccattgttttttatttaccaaagcatatattccatgataatatttagtgccatttacaaagtatctaacatctccaggcattttacaattgtgatgtccttgccaaaaccctcctaaatatgtattattatcccgttttacagatgaggacactgaggttctgagaagtgacataatctgcatatcatggcagagcgaagactagagaaaaggctatccgattcaaaaggctgctttactcccacctgcagtatacgcctaccaccacatgctactgattttggcagccaagagcatgactctgtattttaacaggaaaagccagagatgaaaagtactgtcattagcatagctcctcaaggttactcttaggaatcctaagcaccataccatgcagcactatacaaaaatctggttcagataatgatgctggcccaatttatctgtcatgatacggctgagacacacacggcttcatgcatcaacttactatcgcaacaaactattagcaaaaaactattattgggtttggggaaagagcagcagtcctaatgttctattcccacagccattctcataggaaagggttggaaatagaacagagtctatctttacgatctgaatgacataagagacagtggatgacacaagcacaatattctgctttcataattttatgatttcctgtctagtctgcaggaacaagtaaaacaacaacctctctggttctgtgatagcatctgtccttagaaaacactcatttttagcacagtcagggttgaaattggatgagaaattcaggggtttctccttagcctcagttgttcaatcttcagaggcccactgtctgaaattcaggggaaaaggggctcagtcaacttcatattaactttttcttaatatttataactgtgacatgcaactataactatattattatgtaaattgagaaacggaaaggagagaaatgactcattatatatctctctgggaacttccatcaaaaatgtaaatcatgtaagtttcagaattctaggtgggcacctggaatcttccacttgtagttttctttggagaagattaaaaataaagaaaaccatatgttccactttagtgagcaagagtgaagggacatcggtattaaaagcagaagcaaaataggcagatgagagcttcattttatactgagaaggcatgggtgcaatttacctgcaggccattttcactgggacaacgaggaaaatgtgcccgtgcagagacaaggagtccccacagtctaccccttccaccaattttcagtgttttcctgaacagatttcaagcaacaaaacagtcagctgctgggtaatagctccggttacagctgaaaatgttagtcatttcattatacacactccaaaaggggtatataaaagttgtttacaagggcaaagccgtagttctgaaagctggctttaagagctccttctaccttgccatattttaattctttgaacgtgcaccaacaattacatttttataactgctagcacaggaagttattaaaacacttggctcctatgtgtcttggtccttgcctctgctggaacattgtaaattgttatggctagcacatttgtgcaaacctactgagagaaacatcatatggaaataatttcagtggctagtgaagggtagttaaggacaaccttaacatctaggccatatgatgcagtgattaagaggaaaggtgctagagtcagagggactaagcttgaatcctagatctgcctattaatccctatgggagcaggtcacttagcctatcaaagtctcggtgttcccatttgcaaaatgggaacaataagggtacctccctatataggatgtggtgggaattaaatgagatatacaaagcatctagtaagtgcccaatgttagttaattattaattaattgttagttaataattaacataagctagttaattataattagttaataattaacattaaatgttagttaattgttggggtgatatctttttctcttctacatcagggcagagttcttcaatctgtggcagaatgaaatttcatgaccaaatccatacaagaaagtgttgtaatcactttcttaagagtactgaaagtgaacaatgacaaaactctaccttgtgcctccttcaacaaggggtttcagcccacagcaagattgacactgctgcctggccatgtctgtaagtgagtgacagcaggtaaacaattgtcagcatcccaaactagtatgttaatgtctccccagtggccacgtttgttatcctgttccctcatattggaattacttggctcaggagatctgccaataatatacttttggctgggttttgaaatcaccttgggatacccagtcacacagtgaggctttgtggtacatggttctctgtgccacgtttcacacaggccactgaagggctgtcaatattggcatcaggagagctgagttcaagtcctggatctacctcctattgatgatgtgattttgggcacattatatgaactctgagcctctgtttcctcatataaaaaatgaagaatggggataatattatttatttcacagggtttttgtgaagactaaaagacgtgatgcaaaagggcattgtaaagtataaagagccacatagatgttattataacttttggtaaacaggatcatcattgttggatcagttgcttatattaagaattctgagggtttctgtggctgaagattgccatgatacacataagaataaatgttatatttcttatttaaaggtcagagtggtgagattggataaggataaggtacaatggtgagaggtgagtggctgtttgtacagggctgtgccaggctacagggatgcagaaaaagaagtgtgcaaagacagagcaagatttacttattcctgatttattagaactgaatttctttacatttttcttccttccttacaggcatatcccatttcatccttatgttctttccaaatctcattcctggaaaccctttctcccctagtctcttgagacactttggacttagcactcatgaagcattaatttttaaatggcatatgcttttacaggatccagtgctgaccccatgaaattagccctccctatttagaaccacccaattatgtagagactcaagcacaatgagatctgcaattctctttgcctcataagtcttaaggctttattttcagcattgtcttgttttctttctccaaaacatccaggaaactgaatggctggaagtctgactgcaaaacaatggttaggatagtggccaaatatgtgatgtttctgaatatggaggaggtgggcctgacattccatgctgcagatatgcaagaataactggaggaaagaaccaactggtggggcatagttggcccctgtccacattcacttttcctagacagtcttggaggatggatgctttttccttaagttaggttttctcctccccttaggcttttacctatataacagaaacagacttctaatgatatatttatatatgccagtaacatataatatatagagatgatatagctgtgtattaatagttgctctgctatgtgtctataataaacactacatagcagttattgatttatctctcccactaaaatacctttaggggtattcagaatagacgcccctccagcagccatcttgatacactaagatttggggaagcaaacaaaaatagactgagaatgggacaaagatattacactaagtatttgacttaatcctactccccacaacctgtgggctgtattgcgctgacctcctatgaagccaaggacagaaactgtactctctgaaatcttaacataaaataccttccatgccatttatgaagccactgtccctcagcttcaaatctaactttctgtactttgctttgaggtgctgggactaaggactagcaacctgcgtttctgctttgccagctgatccttgttaggttctgccagtagggggtgctaaaggagactgcgaggccagaggacacgggagagatctgatactcctagtagtgtcagcttagtgtttgcttcaagcaaagtgttgctggcctcgctttttcattctggcagcagcagttcctccctctaacagaaatctaattcagtttgcagtttctccaacgttgcagaaccagcctcattgtggagattttctaaatgcatgagttaaaatggcaaaagtggaaaaataaggatgagagagagagagaaaaaagatgtacatacagcaagtataggattagaaaggcattaggaaaagctttacctgtgaaaaacccctttccccctattatattttaaacctgctgagtttgataaaatgagaactaggtcactattgcagatgtgtgttttttttttttttaatgagatgatttgggtcaactttctatataccaactttatatatagttgtttcaaaggagactcagcatagcaaagagagagcatagtaaaaaattcatgggaaaaaagctgcaatcaatgtagaatgagtctttgaaaattagccaattaatctggctttgctttgtttccctcatgtctagggacttgatttacataaaataaatccagtgtgaacaatgaatacatacacagaaaataagagttgaataaaagattacttatgtatatgactagacacttcaaaggcttatagtgaaagatgaatcaccaaaggctatatctgaaaagaactccagacccatgattttcttaaaatgaactataatggattctgtaaggctagaaagggttcaagacagaactgtaagacttctcatatggtccactatatacaacagccacctgcttgctattgccattaatttctgccttaattctcttacagatagaaccagatacaacagccaccctcttgctaatgccattaatgtttgccttaattttctcacagataaagtcaagaccaattagtggaaaacacacagtggtaaatttcaactccttgaagaaagtttctaatgatctcatctgtatgatgaaggatcagctacctaggaaggtagttaatttgctccaactagtattagtgaagcttaagttggaggactgcttgaatctagaatcagacgggagagtcccttttgcactgagattctcaggattctttagcagccagtaacaagaatatgttacaacagaaattaacagctctattcatttagataagagaggatttgagacagaaccagcctttaactggagtcttttttttttttggcttcaaccttagcaccttctcccacctcaaggtgtgcattatactctagaggagacaggatgccttacagtaatcatatttttcagaggctaagttgctcttcccaaaggaaatacagtgccataatcatgtataagagttctgggttcagaaactatctttgcttggatcgccataacaaaataccatagactgagtggtttaaacaacagaaatttatttctgtacagttatggagtctggaactccaagattatagggtgccattgtggttgagttctggtgagggtgcttttcctctgttcacatggcctttttttttctctgtgtgtttgtgtgtatgtgtatggggcggggacgggggaagttggggagagaagagaacaaactatctgatgtctcttcttaaaagggcactaatcccatcatgagagtcctatcctcacaacctcatctaaccctaattatctaccaaaagccccatatccaaatatcaatactctagacattaaggcttcaatacatgaatgtggaggggaggcacaaatattcactctataacataaaccaaagtgtgaagcaaaggtgtggcaacttactagttggatggctttgggtaaattgtatacaccctctaaatctcatttacttcactggaaaatatgaaccacaataacttctcgatgaggttttggggtactgcataagtcaacaaacagtaagcatgtttcacataaaaaatagtccaagtaaatgtagccactactactgttgttgttatcatcatcgattccgataggacaaggatgaatctggaagttattccatacgctgctctttctgtctccattacctagcccctgccttgctttgctaattagtagttatgcttaaatccagctcaagttttactttgtctagaaggccacctttgattatccccatgagttagatggcacggaccttgctctttcatgacatactaggatgcatttgcatgcaaatagccttaccattgctgggtgaatgtgattttctttctttgattttgctagctagactctgagatacttgaagaaccacctggagttagtcccagcttcacagttaagggcatagttttccacaaactcctctcacttaagatgccagtcacaagtttggaggtctcttgggccactgtcacttttgatgagctggatacaaattcactggtccccacggacaccctcaggtttggtaattcaatagaactcctcccagaactcaggatcatgctatacttgtgattagaatacaaacagggaccaaccaaagtaagagatgcatagaaagaagtctgggaggattctaaatgtgaaactcccaccatcctcaaggatatcttaccctcttagcacatcaatatatgacaatacttataggactgccaaccgggaaagctcacctgagctttggtgtccagagtttttattgaggcttaattgtgtccactgattgactgaatcattggccatgattcactggccatcaataaccagtccctttcctttccccatgggttaatattaggcagctcaaagccccagccttctaatcacacagttggtctttctaatgcagccagctcccatcttgactcaccttattagcataatctatctgggagcccaccatgagtcacctcattagcaaaaactatcaggtgtatgttccaaggggtccaccatggaaaacagagacattcctatcacttgggaaattacaaaagtttagtggttacctcccaggaaccggggaaaaaggaaagccaatttttttttatgacatagggataatgattatgcaccctaagttgcttagtagatcacccaaaacatggtaagtggtccataaatatttgctaaatgaataacagagtgaataataaaagtcaagacaaggccattgttttaaccttatgaaaggagagttggccaattatctttatttttctggatagatttacttctggcatttgaagccctcacatctcttgttctatttccttctctactttctcctattttcattgagttcatcccactatcaccatttcttactactgtgaaacagactttgaatttctacttaaaaccctgcttttgcctttcacaccttttcaatgggattttacagttctgagagctgaggaagtgaaacagaaaacactgtgtaagaaaatcaaattcttctctcagtaacaaaggtgccttgatgcaggacagcatttcaattatggtgttcatttccttccacattaatgtcatttgagttgccactccattacttattattagtcaaatcaataaacaacatgcaggctcacaactcactgcatgtcaaactgaggcgtgcaggtggagctgttaatgcaaactgatatttcaggtgtcaaagggcacattggctcctgagcaaggtttgaggagtgcagtttggttcaacaaacaattattgagtgccttgtatgtgtcagatgttgtgctgggtgccaagaataccagtactaagaaggggcagcatcttcctgaggaacctagtgtcttagggagagtggggatggggacaggcagaatggactttccctctgaggtcctttaattcaaaaaaattcttcagggtctcttcatcaccttctgaagtatgactggtatacatcaaattgcatttattctactgcaccctgacactcctcatctcactttcctgctttatttttctccatggtactcaccaacctctgacacactatgtaatttgcctattggtttatttgcttgtctctcccccagctagaatgtaagctccatgaaggcaagtgtttttgtctagtcattcatagctgcatgtctagttttaaaatctgggtctggaacatggtaggtgttcaataaaaatgtgctgaattaatgaacgaatctactaaacagggggttcctcctgctgcccaaatgtctaagactcctcttgggtagtgaaaaagttgaaaagacatttatagtgcaatgatcctccagagtgggctggacatgttccttaagctgccaggccgcagggcagtgtccatggcctcagggagccggtgggggggaaccaatatgcagtcaaaaccagacaatataatgtgtgttgtctcattcaacccttgatgtatccctgtgagatagaagttattcttccaatttcagaaatgagaagatgggtggtgaaatagcttgcctacagccccacagctcatcagtgctagagctaagctttaaatccatgcctgagagatgccatggttcatgctttcctcatctatgatgttaggctgcctctatatcatatcttagtgaatgtgaaaagtaagcaagatgcatttgctccactagaagcacccacagcctaagctagacaaatattcacagaggaaaccacgttgattctgtaagatgggaccatgcacccctttgcaccattcaaagaaggctgaacagggcagatataaaaatgatgcagtgaatgagctgttggcttccctcatctccctattaactgtgccctggtgacttactcttaagagacatcaaatgaggaaataaatggctattgccaaataaacaaaggcaatgttttaaaagtctctgtcatgtcctgatagttcctgacgatgccactaagcccatttcaactgtcattaatcctagtctgactcattctggttaaggactactgctcccatgtctgagccaacaatgccccaggaaggtactaggttaggaaatattccatcccttgagcaggaagaagactctgaaaatagtatattgtctccatgccttgcttaaaggtggactggagttcacataacagcttctttaagtaaccatgccctctgcactccccctaaacctccttgccactttgtggctatttttcttggcagctagtttttactcctttctttcctgtgctcttctcatctcacttttatcagtgtttccccaaaagcagaccatgcttccagtgactcctcagccatgacagtagatttctctgtatctacagcttaagcaactagctgatgctaagacctctgcctcttaattgcccttgctccttctgcaccctggacatcattgctgaccttcattgaactaacactcaagatacccgctcgactttataattcctggcttctcctttggaggtgacagggcttccttacccttcattataccacttttagggtggttggctagtcaaccactgaatcaatccagatgtcttctaacatagtcacatggtttatgatgttttattttgtaaagcttagcagaaatgtagctccatatagtggttttcaaaccctataaaataatactgaatattttaatgcaagttagataattatcaatataaaaattaaagggaaatttcaaaataatggtaagaacagtttctcagaaatagtctccttaattcagaagttaaaactcagaagtacctggatcacactgagcttatggatccccggtatgaggaatgaacacaatggtttatttctgtttgattggcaatgagattgacatatttctttggctcccctgtgctattaaaaaaaaaagagcctctaaattgagactactgcccatttcagtaagaaatgaggccacatgtcaatagaatataggtaactacacatttataacactgggcagtgatgcagaattgattagcaagtgtaattgcagtaagtaagatgctttctgctcctggtactgatgactcgtggcatattgaaaggaaaaagcatgatgttcaaggaaatgagattctcaatattaagatggggtctaaaagtgcctaaatagaattggaaataacctaagtattgaatgagactgtagagtgtaatggttaagagcatgggctttaggggaagacagatctgaatgcaaatatctgttttaacatgtattagctttgaagtgcagcaagttctttaaattctttaagtctcagtctcctctataatgagacgagatgctcacagtgtttattctctaggtggttgtgagaattaaagcgatgttgcaggtaaagcacagactgcacttgtcacacagccagtgctaaaacagacaaaccaaccaaccccaagcaaaaaactatctatattgttttcatagttcaccagcaattccagttcctggaaggcaaccagtcagtgatctactgaagctaagtcagtctacggatgaggtgcatgtctgtaattgatcagattcagacctagagggaattggtaatctggtcccctcaggacagaatgtggagttctgcctcatgaactcaatctgtaagtatcaggaaaaatcttcccagaatgggaaatgtaaaaagaaagttccaaacatgcctaattatttctaacagattctaaaaacctctcaaaatgaattctgcataaaatgtaaatctaaacagtttgatgatgatccactgtttctacattattcagtctttaaacataaataagcctaggttttctttaaacaattctatcacagagttcaaataaagcaggtgtaacacacacacacacacacacacacacacacacacacacaaagatattctactttagctctctcgtatctggaaatcattcatcttatctgctgctcgctctccctctttctttttaagtaaacattaatccccacagatggtgaaccacggtaatctctgctaccagctgcagagaagaatttttaatgaaatgggaatttaaagggttttacacaaagcaccagaatctattccgctccttctcataatgctcaaattatttttactgccatgggttataaatgcatgtttgtattactgcttctgagagaaactgacctattgcttagaaggtgcttactgctttaagcgtgccgtctcctgcctcacccagtataagggtgtcaagtccccagtaaaaggcactcagtggttaagattacaagatttatcccagaactgaccttattttacactaccaaccctgcccaatctccacctgacttttgttgatatgtctcctgatcttctggcctcccttttaataaactccacagagttgtggctttgatttagctacatctctaactgaaagatttgattcctgtttttttctctccctagtccagcactgctcagactaaccacctggtattctgacatctcctgcttggccttatgaccttcctttacaaataacacttatgagcagctctgttggacaccactcagtgtttatagtcaccagctctcctcgattcttgcccaagagtgttgatatagaacactcatgatcattctcaaatcttttaagaaagaaattcaagttagctatgaagccaaaagtttttttgtttttttttttttacaaaagatgttataaaaggtgacatgcacacacaagtataaaaaatggaaaatcaagataatgtctaatttaagttaagctaattacttttgatgaaaacgtattactttaaaaaagatttatacacctctaaagccgttcaaaatatatcagcatagaaagattttgatgctcataataatttttatatataaattatcaggggggaaaagtcaaactccaatagaaaaaggactattttcacaaattaagggtacacatacaagaagaaaatattaataagattaagaagttcatctctattgatgttatgaaaatttcagccttgaacactaacttatggccacaaatccaatcataaaccatttcaaatggaccaggaaaagaccccaatgtcatggaaagagtagctgcttgaaggtcagaaagcctaagagctggtcttcctggtcctgccatcaactcactttgtgctgggggctgagttgctaggcctcttctagactcagtttcctgacgtgaaagtttactcctgaggcctcccaggtctgtttaatatgggatcaccaggaaacaacataaaacacagcagtaaacttaacaggagtctccctgtcagatccttgaactgatttcacatgaagaacatttagaaggcaggtttcagaaccctggacagagccattttgactcagaatgaggcacggagtgaaagccatttaggctgggtatagtggctcatgcttgtgatcccagaactttgggaggctgaggggagaggatcacttgaggtcaagagcttgagactagcctgggcaatagagcaaaccccctgtctctacaaaaaatagtaatataaaaaagcagtttgtctgccagagtaggaaaaaaatcaaaggacaagaaaatgtctgaatgtcaatttttaggaagactgtcctcaactacccaaagtggtgtttcttactacattatttgtgctcctaaagcactgtataaagatgtctattagaacccatgttaacatccctggcaatatcatgaacttcttaaagcagggcttctcaagttttagtgcttgtccgagtcatcacagccaatcctcagaccttcctgcccaaaccactctttaattagtatttactaaggccaatctattgctgcatgaacttttaggattcaagaatctgacatacagttatgatactctgtcttagcctctccttataaggatgttgacagccagaagaatcacattgaatcaaagccagtgatagaattctgtcaatgactgattatacttatacagttagcagcccctcctaggagattgccctgttgatccaagaatcaccaagagcttttcctgagccatagctttatagggcatgctatgctattttgcccatcatgaaagagctggcagtccacaaataacctgagggcaggatcacactctaaagtgacttgagcaaatgatttgtgtaagctaatgtgaacctcctatggctgtgctgtcatcaaaacactgggtcaaatcaaataagtccatcaaggtgctataaaatatgcatgcaaagagaatggatgtgatgttgttgagaataataaaacagtccataaaagctatgaaataaatcaactgttctttcaggcatggaatacaaaacaccacatacatccatatatattatatatgctgtaagcacacatttattatatatgagcacttattgacatgctagagaaaacaaagtgattaaggtgtttgcttcgtggaagcaatcgccatcaaggaagcattggcacagggactgaaacaatcctttgccctctgatcaatggctttgccaaggataatctcactggtgaacacttcttgtggggaacatgtgtatccctagaaaggatgaattacaaataagaaatacagggggtggtgggattattcttatgccatgactcaggcagctagctctaagatgttctaaagagattcttcgctttcctctaaaaacatgtttttaatatcagatcatggggtgaaaatgtaccctcacccttcagacaaaacattgaatggtagagatttcttctctttttccacccctccctccttccttctttactttcttcccactttacttttttttttttttttttttttttttgagacagagtcttgctctgtcactcagggtggagtggagtggcatgatcttggctcactgcaacctctgcttcctgggttcaagcaattctcctgtctcagcctcctgagtagctgggactacaggtgtgcccaaccatgcctggcttgcttatttatttatttatttatttaagatggagtttcgctcttgttgcccaggctggagtgcaatggcatgatctcagctcactgcaaccttcgcctcccaggttcaagcgattctcctgcctcagcctcccgaatagctgggattacaggtgcccaccaccaggcctaatttttttttttttttttttttttttagtagagacggggcttcaccatgttggccaggctggtcacgaactcctgacctcaggtgatccacctgccttggcctcccaaagtgttgggattacagatgtgagccatcgcgcccagccacacctgggtaatttttgtatttttagttgagatggggttacgccatgttggtcagcctggtcttgaactcctgacctcaggtgatccacctgcctcagcctcccaaagtgctgggattacaggtgtgagccaccatgccagcccttccttcttctttaaactttttttttttgagtgtactttaataccagttgcttctctacttgctatataagcaatgtcagcattacttactgagcatgtgtatgcgacagcccttttctatgtaccagagggtcagaaccacagacacaaatgaactaccaccactaccctgagagagttcatcatgtaccttcaaagactcatgtgtaggcaactaatgcaaatgccaagaagaatgaaacatgtaccttaaaagataatataaccaaaggaagaattactaatcccaactgcagagattttgggaaagggtcccagtgtcctgtacaagatggcatttgaattttgactgaggaataggattttttttattggtaaagaaatgggaaaagcatacccaggtaagaaacagcacgttaaagacagagagcagaaaggcagtggctacacttggtcttttctatggagaatttctgcagtgcctgtgctcccataagtctctggctagaatggaaatacatttccttccttttgatagcacaaagaatagggtttattccacagagtgacttggaaccttagtcatagtgttttttcagctttattactcacctacctgtgataagggcctctcccagcaaagtgtcttgaatcactaaaagtttgtctctccttcgtagggctcatagttgacacaggggccagagaccaagcaagttcaagagtagcaccccaaaccattgtttcttcagaaattatcagccccatcccaccagatttatgacaaacctacggtgttcttcccccttcagagacctctttgtatctctctgctatctgccttctgtcaagagatttccagtgtttagacatctcaatacatgtcagaactccaaatgtagaaaggattcaagtctccttgtaagggtatactaggtcctgaacaaatagagaccatttacagagctgtctggagctggctcatactagcttgcaagagccaattgttaaattttcaggaattttgcaaactggttaataccatattggtagcttgaaattggccatggttggagaatttatatcacagagactggtaaaggctacaaattaggactcttatttccagggagcttattgttaggttcttgccagtactgcaccaagtatgtaactctaaatagccctcaaaccttccacaccagttagccaaaagcacctaagtggctttcagaggattaccatcttactccatatgcatggaatgttggtgtctcagggagtgttgagagatatatatcaacaatggtgctgatcaaacacccactgtcaagagttcaatgtgctgtaggagaagaagagaagtgctggagtttagtttctaagcatgctggctctaatctttactaactgtgggatttgagggaagttatttaagtctctgcattgttttttttccctcacctgcaaagtggggaccataatacttatgtaacagcgttaaagattaaataaaataatatttgaaggtacttagaacaaggtacagaacagagtaagtacccaataaatgatgacaatgaggatagacaactaggttcaaatgctggcactgctacttttcagtttgtaccatcttgttaaacttatttcacttctctgagcctcggtatttttcctataaagaattggaaaaacataaactccttcacagagtgcagtgcattaggtagttggcactcagcaatcgttctatcatcctgatctcagtattacaggacctgggaggcaaaaaactacatctcccacactcccttggagctagcattcataagcaaattaggttccaccaatacaacgtacttgtttgaaatgtagatgcaagagagaggccaattttttgctttttggctttctttattggcaagcatggctgtggagatgttgggcttcactgcagcacaattctagtgtccatgactggccatgggtgtgctgagaggcaattgtgctggctggggtgggcctttggttctgctccttttgactgtggcagtagaagcagctctcctggtttccacagtgttgttctgggagtcactctgagtgtccagcctagtgtttttcttcagcccacccaatgatgtaaatacacatttcactgcctaaaatgaccaaaaacgtgtttgtgttctgcaactagaccctgattgataagcagtgtttgggaggattacacaagcacataggatagtgcaccagacctgcaacacttactattgtgcctggcttctattgtgtgttcttaataaatctgagttccttttcttcccagacttgtcaaccctcctttgtcaatggaagaaaaagacccagttaactatggcttttaatcagcatgacttgttttatgaacttcctgtgtagagtgtaggggaaatgtatatatttgcttcctgaagaatccagaccaatgctctaagtccatttttgtacatataaatacttgaaggataccaaacaatattacaagactgtggctttcatggccaggactatgtggtatattttccttgagagttaagaatcaggtttgggttcatttatgcccattcttagtggaggttttgtccaacccctaatatcatcttattaattccattaaaaatttctcatctgagcatctactcttggagtaattattaaaaaaaaaaaaaaaaaacaaaaactgaaaactcagctctcctttatctgctcttttattcaagtcattttcaaatttgtttcccaggcaatagtaattgtttcagtaattaaaatgtcaggaggcgggcagagttgattagaatagcctctgaccacatgcaccaggaaaggcatatgagagagcaccaggtgacctcattattaacgtggtctattatattaaccttgttacacatgtaaaatgtactgaaaacattgatactcagctcttccttgttttgtttctgatacctcaagcaatagcccactattagaattaaccactgcaagattattacaaaatgaaggacagaaaaatgaaatgtagatatgagttgaaataactctaacaccaaattcagcatctatttctattactcatatagagtgtctgttttacccaaggctattgcaacttaaactgggtctttcctcctgttgacatgtctccacgcttacccttgggcatcctgtatagggtagggtgaggggtagtgagtaaggaagatgtttttcttctgtttttttttcttttttttcttttcttttcttttcttttcttttcttttcttagggtctttctttgttgcccaggctggagtggtttgatcatggttcactgcaggcttgacctcctgggctcaagccatcctcccacctcaacctcccaagtagctgggactacaggtgtaagacaccacccccagctaatttctaaatgttttttagagatagggtctccctatatttcccaggaaccaggagagctgcttatactcttatactgcccaagttagtcttgaactcctgggttcaagcaatcctcccatactggccttccaaagtgctgggattatgggtatgaggcactgtgcccagcctagaaaggcagttttgacctggatctagatctgtgttcctagactgatggagaaccatggtattattagaaggttaccaagtcaccgtgatacacttaacactttcaagagtcaacacaatggaacgacaaatacttttgaacttaaaagtcatttaagctctgtttacagctcacagtccttcttcatgtggaggcagctttatgcaatggggaagaaggctgtttctgcagtcattctaatctgggttctattctttatactgcaccccaatctctgggacagagacaagtctctcagccctgttcttttgtgtttttacttatttttaattttttcaacttaaaaagttatttatattactaaagtttattttttggggggggtatatagttaaatgagttttagtacatgtggattattgtagccactgccaaaatcaggatacagaacaattccaacacccccaacatttccctcaagcagtttcttttaacttaactccccttcaccaccctctgacacttcttactcctggagaccgctgattgttatctattcctatttcttttttccagaatgttctataaatggaataatataaaactttttggagtcagtttccttgacttagcacaatgcctttgagattcatatatgctattgcatttatcaatagttcatttctttttattgctgagtagtatcccattgcatggggaccatggtttatctgtttaactatggaaagacatgagagttgtctccagttgtcagtgatatagataatgcagctataaacattcatgtgtaggttttatgtgaagataaaattttatttcttctctcgtttttttttttttttttttttttttgaacaaggtctcaccctgtcacccaggctggagtacagtggcatgatctcagctcactgcagcctggacctctcaggctcaagcaatcctcccacctcggcctcttgagtagctgggactacaggtgcatgccaccacacccagctacttttttttcatctttttttttttttttttggtagagatgaggtctctctatgttgcccaggctggtctcaaactcctgagctcaagtgatcctcctgccttggcctctcagagtgctgggattacagcatgagtcagtgcacctggcagtttttatttctttagtgcaaaatgtctccaccttgaatttaaagtggaataaccctttgttgtggggaatgtcctgtgcattgcaggatgtttggcagcatccttggatctatccattaggtacccgtaacagcctctgaaccagttgtgaaaaccaaaatgtctcctcacattaccaaatgttggggggcaaaattgacttcagtgaagacttcagtgaagaattcagtgacttactgaagacttcagtaaaaactcataagcaagatcctggtccatatggtagtatatgtttcactttaaatgaagctgccaagctatttttcagggcatctgtaccattttgcattcccccagctatgcctgagagctccaattgttctgtatctttgtgagtacttgatattagcaggtttcttaaattttttgccattctgtaattagggagtcccttgattttaaaatcaggaacgacaccgtggcaaatattagtgcatgcagctcactaatatttctagttctgaaattctcctcacttgagaaagtttcatttcctgctccttttaggttgcatgtgactatatgaattggcttggctagagtgaaagtggggtgggtcacttcatggtggacatgtgtaggagctgttgcacactgctccatcttccctcccccaagctttagcaaccacctacagtccagatggtggagatgtcatcagccaatgttgctgagtagaaatgacatggaagagagtaccctgccaaacctcaaatggacatgaggtatgtgtgagaaataaaactttgtttaaatccactggtattttgagattgtttgctagcttattttgactaaatcaaattactatgtgatagactcattgtgagcatttatgtgacaaatgtgggtaatgcatttaacacaattcttggctcaaaaggagttcagagtgaatgattgctactattataactatttactcttccctgaccatcccgcatcatgatgattctctctttgataaactcacagcttttactctctgtaatgcattagcagaactactttagcttcttcaatgcaccttggcaataaatcaaattcaaagatatgaagttaagtacccatttcattgaccacctgatcatcaggtgtgctggtacaccatctaaggttcaagggggtagcatcactgtattggtgcaaacatctctaaatgacaattagtattactaagtcattttaaaacctgtcttctataggtcagtgtatagaaggtctttcattaaccagcaactttttcacattttttgtctatttgtccatttcctaagaatataaagagaggtaaagaggtataaaaacacagtgattctcggctgggtgtggtgactcacacctgtaatcccagcactttgggaggccgaggcagacggatcacaaggtcaggagattgagaccatcctggctaacatggtgaaaccccaactctactaaaaatacaaaaaattagccaggcatggtggcacacgtatgtagtcccagctactcgggaggctgaggcaggagaattgcttgaacccagaaggcggaggttacagtgagccaagatcgcaccactgcactccagcctgggtgacagagcatgactccgtctcaaaaaaaaaaaaaaaaaaaaaaaagaaaaaggaaaaaagaaaaaaacacaatgattcacaaagctgatagtgcatcagaattacctccagaaagttgggaattctggttctaagatttaaccacactgaggcctaagacttaacatattttttaaagttctccatataattctgataagtagacaagttcagaagcccctgcattagttgtagaaatgtaggaagtatgaccctaagaaacttggcaagacgcagaaaaactcctgcaattaccccagctatttagagatgtgaagagtttctattacctacctggcagaatcacaatctgtcataggatatttttcacattattgttcaagattgaaatgtatccctggctctgatctaactggcagacagacctgaggaagagaactcaactctgtaggcaccagggttcatatctgcaaattgtgtgagttgggcttccacctataaaaatctttgatccattatcttctgtgatccaggtattcattttaattactcaatcagattattgcatgtattgaggaatcttctacattttccaggattttaatacataatatgagccaaagaaatgtttttcaagcttataactattcattcactgacaaacagggtgctcttccaaggaactctttttcaattttttcatgttcatatatatatatatatatatatatatatatatatatatatatatatatatatatatatatatgggtgtgtgtgtgtgtgtgtgtatgtgtgtatgtgtgtttgtgtatatatatatataatgaacaaatataacaataaaattctataattcccaaatctcaaaataaccacttttggcattttagattattgttttcatttttaaataaaaacatatactatataactttgtgactttcctttttattttccattataacatgagaatttccccatgattcaatttattcaaaatggaacttaaacaactgaatagtttcttatcagttggttatcacacttgtgtagccatttatctactgtcagatatttcaggtggtttctaattattgtccactgaacatggtgttacagtgaattttttcatgtgtagctctatttctttaggataaactaccagaattggaattactggggagacaaatactacaaatagctgcataagcctttaaaatgtcctattttaattattttcttcttctactcatctttcttactgctcccaagattatctatctaacccagagattctactctctattctacttcattaaatctactatgggatccccattcaagacagtggagctgagcacacttatttgataactccagacttctcaatattattaagatgaacaaaaaggtctaaaataaagacctacatcaacgaaaactctagaaaacaggagtagatagaaacgttgagaaacttctgaatgataaagagcaagtaagataggcttggctgaagtgaggaccagagaacagagtgtcccaaagctgaccaatgaaaagctcactgcagagaggtcattgctcccaacagaatcctggagaaactgtgagcatgaggagcagaaatgaaatgcaaaaagtcccctattaaattcttcttatccacattagggaggagaattcttctaaaaagaaaaggaagtgacatgtgtccgtgagtgaacttcactgaccaatggcactccttgagtgaaggtgtattaatcatgtcttctattttctgtatgctttgatatctggggcctaggtgactcaggaggaagtgcccctccaagggttagccaattcctagacataatgaacaatttgcctctaagcatgcctttcatatgcaaactggccaatccagaatccacacctcaactatcttctttatagggctctcatactccaggccactaaccacctgctctaatcaccccagagcctgctgaaactaataagccagtcctaaccctgctttccttgccttacctcttccagcagaaaccgtaataaggctcttccccatagttccctcctccctttattcctcctgaccaaccctggtatgtccccgtgtggtactgagtagattggcatgccccttcctcttgggaactgtcagcaaaaaaatatttttttttctttttttttgaggcagggtcttgctctgtcacccaggctggagtgcagtggcatgatcttgcctcactgcaaccccatttccagggctcaagtgatccttcctcctcagcctaacaagtagatgggacggcatgtgccaatgcacccagctaatttttgtatcttttgtagagatggtgtcttgccatgttgcccaggcttgtcttgaactcctgggctcaagcgatcctcctgcctcagcctttcaaagtgctgggagtataggtgtgagacattgtgccctgccacaaaatgtcttttccgtggcaattattttctaatctgttgggctcactgcacctcacatttttaataccttcccaacttaactgttgactccctgccaatctcctataggaaatcttatttattggcatatctggtaagtttcagtaataaaaaaaaataagtaatgaaagacttacgtggaagcatgaaaaaaaccaatgttcatagtgcattgatagatgaagaaagaaactaaaagagggagcacagaacttatttctacaaatatatgtagaaatgtagttgtatttcaaattagtggtgattagacaatttatttaatatattgagtaattagaaaaaagttttatcggccgggcgcgggtggctcacgcctgtaatcccagcactttgggaggccgagacaggcggatcatgaggtcaggagatcgagaccatcctggctaatacggtgaaaccctgtctctactaaaaattaaaaaaaaaattagccaggcatggtggctggcgcctgtagtcccagctactcgggaggctgaggcagaagaatggcgtgaacctgggaggcggagcttgaaatgagccgagatcacgccactgcactccagcctgggcgacagagcgagactccgtctcaagaaaaaaaaaaaaaaaaaaagttttatccttttatcatacaatgaactcaaaataattttgagatagattacggatataaaaaaccataatgattaaattaatagcataatgtttttataatcttatgctaaagaaggatttatcaataaaggacgaaacccaggattcacaaagattcatgtattttgtattttaaaaatggaagctttggtacaccagcaaaagtcactataaacacattcaaaagacaaatgataaaaaagaaaaaatttgcaacacctaaaacataagaatggttaatattcataaagtataaaaacataaaaatcaatataaaaaagacagcctatctgatagaaaaaaagaacggggatatgtataggcaatttacaaacaaatacaaaaggcaaacatatgaaaaggtgatgaacctcactaacaaggagacacaaattcagtcaataatgagagggcatttttcccatattaagttgtcaaaaattataaagactggtaatatccaggtttggcaaagctgtgtgggaggtgggtaggaacggaacatctttcactgttaatgacaggagaacagctttggagaagacaaataggcagaacccatctaaactacaagttagtgagtttttggtttggcaatttcacttctaggcacatatcctattggaatgcttgctcacatgcataaagacacatgcgcaaaatgttagaagctatatgatttgtaatagtaaaaaagtggaggaatgctaatggttcatcaatagcccacagttgaatattgtggaaaacttcgcagtggcaacaaaaaaaaaaaaaaagaaaagaaaagaatagagttacacggcctgactttaaaatagatgcgtatgttatgctgttggctaaaaagaaagaaaagttgcaaaatgatataacatgtacagtattcgctatgtatatatgtgtttataaaaatattttataaaagatagctatttatatatacaaaatataagtaattgatgaaaaactgtttcataaaattatcgtgttatattatcatatcctttttcatttttcccagttaatcatttgaattcccataagccttagtacaagaaaatccaggatctcccacttgagattgcctatccccagaattgtcccaaaacctcagcacctcattaatgccaattgtaaattgtgtgtgtgtatgggtgttgggggaggatggcaatccatcttccagattcaaaagatggaactaaatggggctggctttctccaggtatcacctgactacatcgacctggcatagtcaagtctatgatggtaacacttgactgtgataatgccgcctgatttaggatgtcaagtacttggtactcatagggtgatgctccctatggcttttgggctgagttcagctgtgagtgtggctctctgtgctcagctctcttgttcctacacaaacaacttcacgggtctctgccagccagagcaccgagtcaagactggaatttgtcagcttacagacctaaccttgccatcctccttccctctctagggagcctacaaagaggtccaggaaggttttctttttaaaatgtcagaagttgctatttgttctcctttctcagaatagagtaatagtttggcacttctctcttgaaaaaagttgtgctcccaacagatataatcctggctgggtacatcttgggtaaggtactggtggaaaattttgtttgtatgatagattttatgtgtacagtgcaggtctagaagaattcacactaaactattagtggtgggtcatctccttttgggaaggcaggaagtaatgggagtgaaactaagtaactactgtcagtcacatttactccttagcactttggagtaaactgtggtttgattttattttgacagggttaacaaacttggacatacacacacatacataaacactcatgcaaatcaacttaaaaataatacaataaattttctttctctcttctaatttttcgttttctgttggatcattcttctctgtgtatactcaatgttctgttattcttcccaacttaaaaaaaatcccctcctgatcactcttcccacttgtgcttttattactccatttctttgagctttttacattaaaagtcctcaagagttatccatattcatttgtaaatcctttcctcccattttctcatgaatatatgctaatgatcccccatcccactcacttctactgctcttgttaaggccactaatgaatggcctccaagttgttgactccgtggtcattttcagtctttaccatacttgacccatgaacagctccttctgcctgagaaccctttcttctttcatcttccaggataccacactcttccagtttcccagctccctccctggcagctccatcttaagttcccttcctgattccacctcagctcctccccatcttaatgttaggtgctccagggctcagtccttaagccttttgtctaacatgatttcattagccatggctttaaatatcatctatgttaaatacacctcaaaatttttcttttagcttaaccctgtccaggattctaggtttatacactctacctcctatttggggtctccacttggatgtttgacaaatatgtcaaacttggcatactcaaaactggctcatctcatggtattctctcccaaatctgcttttcttatatttttctgcaaaatgataaaggataacttcaatcccttcatgctcaagagaaacccttgtagtcatccttgacccttcttttttctttgcattccatatttaacctatcagcaaaatttgttgactctaccttcaaattatatccagattctgaatacttctcactagctcttctgttgcctccttgggtcaagacacagccaccctttccctggattgttgtaatggccttttcactggacacctggactcagtctttgagaaccttcagtaattttcaacacagagtgatgctgtaaaactctaaaacagatggccactttgctcgcagccctacataagttcctcattgtactcaaattgaaagcaaaatccttgcaatccctctcacctcattgccctctactcctccactctccctctccagcctccaagctttctctagaacgggttgtcttgagatctttgcatctgctcttctccctgcttgggctattctcccctgcaaacacccaatggcttgcaaatttaactcatccaggtctttgactttatgttctattctcattgaggctttccatgactatggtatttaaaatagcacacagcttctcctaccctctctgtatttccgaaccttttcagcattttcttcttcatagcacttagtacaaaatgattagtgtcctagtgctgtgttacaaattagcacaaactgggaggcttagcgcaaactgggaggcttagcacgacagaaaagtattgccccatgaactgtgaaatcaaggtgctggcatggttggttctttctggaggttctgagggagaatctgtgctgtgcctctgtcctagcttatggtagtcaccagcaatcctaggagttcctttgtttgtagacacatcattccaatccctttcctccatcatcacctggctttcttccttatttgtctgtattcttgtatcttcacatgccctttctctatgaggatatcagtcattgaaattagtgcccaccctaatccagtatgacctcatcttagttcgactgtatctgcagactatttccaaatgaaatcacattcacaagtatcagggattaggggttcaacatatattattgggagagacaattcaacccctagcaccatatgacatacaacatatttttacttcattttttgtctttctctttatacaagaatgcaagctctaagaaagcccagagttttgtctgatttttttttcactgctatacctgggtgggatgcaacccataaagacttgttgaatgactaaatccctctgctagctcctcatgaccaagaggacgaaggtccaaacaatggatacagcattcatgctgttagacaaactgggcctcactgaagttttcacccttagctttcatcacttccctcagtatctcctgtttctactaaggtgaactcctggatcttactcaaacacgttcacaactctccttatttgctctttctctccccttcacccccatctactcctcttttcctctacaacacatatttctctgttaaaatcttacacattctcctaagaccagctcagttctcactctgaaaccttccatatgaacagttaacaacctctttttctgggtccctttcagttagttattatttttctcactagaaattttatcatcttagcacatgagtgcattggtgtagaatcatgacaacacaaatcttctccattcaactgggagatctttcagacaggggccaatgccttccttatctcttcatttttccttcagtccaacccccagcatctatccagtgcttggactgtaacagctgcatgctaaacacctgttgaccaaatgaaagaagtagggtagatttgccttcttaagctttgaagtaacagcaaatataattttggccactgggccccaggatatatgtactacatagttagccaataagtaggtgggaaagatgaggtttctaactaaggcattttggaagttacaataaacaaaagccttcgagaaaaggccttagtcatggtcagagagtgcagagagattagcaaaggagaacacaaaatagactactcaggaggacaaaaaactggacttaagctgtctaatagctaatgcccatccagtaagtgaagggcagaatcctcccacagccacctgcattattttctaaagaccatcccttagagctgtttttagaggtattttgagcattgtgggtgaatgtggcagtgtagtcttagatatagatgagaaggagtggctataaaaactgcaccttccaactataaaaacttcctggagtaacaattccctcccacaatgtaattgaaaagtgcaattgatcttatctttaaagagtgttctacaaaatcttagagtcattctgttagaataacttgaatgcttttaaaaaacctaattcctgggtctcatctaagatgccctggaatcagatctttgcagtagtgtactagaatttgcactggcaataagctcccaggaaaatatgagaatactaatatttaaggattcctacattaaggaaatccatccctaaatccatgtatatgatttatcatggtcagccattgtgttggttaattttatgtgtcaacatgactgcactaacggatgcccagataacaggtaaaacattatttttgggtgtctgtgtaggtgtttctggaagagattagcatttgaatcagtagaactagtaaagaatattgtcctcacagaatgggccagaattatccaatctgttgaaagctcaaatagaacaaaaaggcaaaggaagagtgaatttgttctctgtttgagcttggatatccatcttctctcaccctgggattttggtacttcttgttcttgggccttcaaactagaacctggacttatgccattagctccccgtgtgcaccctgctccattctcacgccttacttatgccatcagctccccctgtgcaccctgctctattctcatgcctttggacttgggactgaatcacaccactgtctttccaggttctccagcttgcatatagcagataatgaaaattcttggcatccctaataatgtaaaccaattcctataataaacctcctcatatatatatcctataagtctgtttcagtagagaacttcggctaatacaatcttattcttgaaaatctggaaaggaaaaaaatgaaaaaaaaaaacccacaagtctttgtatagatttgtcttcaagttagggtcttcttaaataccccctccaatagaactgctcttaaagaatagacacgcagaaagaagcctctaggctgaggcaagcaggcccacaaggctgaaacacagaatggaggagagcagcagttcttgagagcttgttagcaatcaaacctgaaggcaggcggggactctgagatgagtagaaactctgggcagccattcagtatacttttcagcaacccagaactaaatgtaggcttcagatacagagttatattatgggaacagcaaagtctttggactaacaaataacatggttgggatccttgctctgccaattacttttggttcagcgaatctgggtaagttatttacctcagcctcagtttccacatctgcacaatgcgaacaacatcaccacttggctggcttattgtgaagataaaataaaataaaagtgtgtgttggctgggcgcagtggctcacacttgtaaccccagcactttgggaggctagcttgtaatcccagcactttgggaggccaaggcaggtggatcatgaggtcagcagttcaagaccagcctggccaagatggtgaaacccctaaaccccttctctactaaaaatacaaaaaaaaaaagaaaaaaaaaaaagaaaaaaaattagtcgggtgtggtggcaggtgcctgtaatcccagctactcagtaggctgaggcaaagaattgcttgaacccaggaggcagaggttgcagtaagccgagattgcgccactgcactccagtctgggagacagaatgagactccatctcaagaaaacaaaaacaaaaacaaaacaaaacaaaaaaaactgtgtgtgatcacttcacatgatagttgaaacttggtaagtccctgaaatatgacatcttctagatttcttttccttgtctccagtaagagataatcagaaggtggtattgatttttaaaaaaaaggagaagaaaggaaagaaggaagggagagaggaagtaacaaaaggaggaaggaaaaagaaatagaaaaaaagaaaagatacacaaatagaagaaaattagcttggttcagagttttccagacaaaataagctactttcaaatatcatcttttactgaacatttacattaaaatctttaagcggtacaccatgccattgtagatttctccaaactaaataaaaatggtaactaaatagtagaataaggattactttctatagctgagaatgaaataatttgaaggtaaacattggaaagctcttaaagcatcctaaattgtcttttcttccttcaaatgtcaaaatacctatctcaatagatatttttaaattgcattcctctttcaagatccttctatcccttgtgtctcttgcttaggaatgaaataaataacttagttggaaatgacataatctctggtaggatgggagaggagtttaaataaattccaatttgaccgtcttctagatcttggtagatactgataatgctttgccactgagatttgtggaaactggagagaaaaataatctttgtagtgtgttctgctgttcccattacctattgctacataataaatcatcttcaaaattcagtggcttaaaatagttatttattattataactcatggttccatggattgactgggatcagctgggtgactctcacttggggatctttaatatggttgtcgtctggagatacattatgtgaaggttctctgggatggctgtctaagatggctcactttcaaggctgacagttgctcttagaagttggccgggagctcagctggtgctgccaatcagaataacaacacatggcctctctaggctttgtcttcttgggcatggtggctgaattctgtgagggagagtcccacaagtgggcatttcaagagacccaggtggagattgcaaggcttcttatgacctagatgtggaagtcatgcagtgtcacctctaccacattctgttacttatacagggctagtcaagaatcaagcaggtgggcaggtatggtggctcatgcatgtcatcctaacactttgggaggctggagaaggcagattgcttgagcccaggagctcaacactagcctgggcaatgtggtgaaatcctgtctctacgaaaaatacaaaaaaattagctaggtgttggggtgaacacccatagtcccagctaaccaggaggctgaggtgggaggatcacccaaacctgggaggtcgaggctgcagtgaaccatgattgcgccactgtgctccagcctagatgacagtgaggccctgtctcaaaaataaaataaaaccaaaccaaaccaaaccaaacaaaacaaaataaaataaaaaagaatcaagtgcacaagtacttgagtacacaaggacatcactactgggaagcatggttcattgggggccacctttggagactagctgctaggcttgcctacattataattaaactttcctacccataggagcatttctatctttgtcagatcaatagtagcatcacttaccatttaactacaaatttctaatggaagtttcacctgcatgtatgaaaacaaggtttccatcaaaggtaacaaaacaaatgaccaaaagtgtttttgctaaagaatttgtgaaagctttttcattagctgaacacccactggagacatcatgctttgagactttctgacctcaatccctagacagaaaaagagttggtgtctcccagtttgcaagcagtcctggggaagtaggttggcaccgatgaaccctttacattgattatcttaggcagctcaattcacttagttttcttcagttgaagaaaagggggtagcaacaccggataaattttaggggcacttctctcctgacattccattaatgtgccaatggcttagtgttttgcaaggaacttcacagaatagaacagttcggttaacttctggttgttgtaacgcatttttacttaataatctctcttgtctgtgtttcaggtcattcatggggatagagtaggcagggtgtgtagaatcttcttccatcacagcatgaaactgagtgaagacttcagaccatgacatctgcagatgttgggcttcagttgtgggttcgtaaattctcgagtttaagacttgttgccatttgctcaatatttttgatccttggcttcctcatttgtaaaaaataccaaacccataattttgttggaaggaacaaaggagctgaactttaagaccctaccctaggtctccctactactgggctattttgttgtttgtttgttttttttgccttttaaacctcgcttgaatgatttaatagttatggtgtacctgtagcttttagttaccacacatctctttgagaagtagtcagggtatgaataatacacataaataaaaaatgagtgaacagtatattaaagcaaagtaagcctgtttgaaaatttggactcaaaccatagtttcaaacccgtaaaaaatatttattgggtcactagtatatatagtgcactgtgctaggctctgtagaggactgaattcataaaagcaaaagctgcctttattctacttatccagaggttactgaatttggagctagttgacagttatgccaggagaacacaccagtctgcctgcctgtcaaggagagaattaaaaacttgtttctgctcagtgcacagcagacagcccggaaagagtcttatgaaccaagcactgcaaacaaggccatatctcctcctttccagatttttataagtaggtcaacaatagttcaggaaagatggaattccagatctaagaaaataattttgattgaaaaagatgcaaaaggcagtagagacaaataagagattccaatgattatcagtggtatttaaaacaaaacgaaatagcccaaaacaatcacatctactactacgcattcattaccacggagacactaaggatccaccgggccaaggtgccatgtggggactgaggtggtgtgtgtgattgggaggggttgttggtagtgaataatagggcttttagtaatgcacaaagggagagatgagacagatacccaaataactgtaattcaagagagaaagtgctaagtattaaagaagactgaagttctaaggaacgagaaatagcaccactcaggcaacatgaggaaaacctgttgaatggggaagtcagacttcagcctggccttgaaacagaggtggtaatagttagcgatttggtttggatgaataatagagtttgtgaatggaagaagtggaagaaaagtctggaaagaaggttgagaccagactctagagcatcttcaagattgatgtacagggtttacgttttacttggaaagtgttatcacgtaagaatgcagccagctgcaattgatggaaaaatagacagtggtttacatgagaaagcagttggtttactctatggaagaagaagtcaggaggcaggcaggtgagggttggtatggtggctcaggaggccatggaagacttaggctctttccttttgccccgccctgtcattctgcacaggtagctttcactctcacgatgggaatatgactgctcctcttccagccccatgtctgcactataagcaggaagaaggtttaagggtaaagggagggccaatcccctcccaagactgtcacctacatctcaccggtgaggaatgtatcatgccatccctacctacatggggggctgagaaattgagtattttctattttctgagtctttggcaaagaaagcccagggaaaaggtaactatgagtcccttttgagtagctagttcatggcattcgccagagaactattatggtttttgagcaggggaataaaacactgcttgatgattaatttggctgtaatgcatggctggacttggagagaatagttacaaagagaaagatgagaactcaaggtgcagagacatgaagtgccggattcatggtcctgtatgagtaagtggtggaactgggatttgaatccaggctagttgttcccagcctttttccacctatctctcaaagctactcagtaaggactttaacagaactatctcttatatagagccatctgcataaacaacaatgctaggaagccattaattcatttattccttcaattctgctttaattatgtatactgttgttttataaacaatcctgggagatagtataataaaaggaaataatgagaattcagagaaaggtagagataagttcaagtccagccatttctcttgccaatggtgtgattttgcatgagtcacataaattctctggctttcaatatccttagaggaataacaatggcagaaatgtataaaatgagataatcttgttatggcaaacatatggccaatatgggttagttggcccagcctccgttccaaatttattctccctagccaattccggctaaggcagttggtgtgttactattctggccaatcagacataggtgggatcagctatagtctcaatgatatttttacttttctgattcaggttcctccattttatactcctttcttcctgctggtgggcatgatggctggagttgatgcagtcattttagcacaatggggaaaagaccacgtgagtactagaggcttcattatgaataacattgaacaactggaacaacgctagcagctgcaaatcctcaaacttctcattatgtgtcaaaaataaactacttgtattagacactatggctttatttttcattacttccagttaaaaacacttaaaattgatagtttataaaagcacttggtacctactttatgcttaataagtgatgtttattattattcttgtcatcatcagtattattgttattgtttttataagttgcataatatcaagttacaggctaacagataaaaagactataatcaaaatacataaacaaatatgtgatatcctaacgaaaaaataaaaataaagccaccatgaaggattgagagtaacatgaaaccacactggttctgcgtgggtggaaattgtctgtacggatgttggaaaaatccacgctctaagtccgaagccagggttatagtaaagggcaatctttccagatgcagaaacatagcaaccatggcaggggatacgggaagggaagcatttctactggggtattttgagtgatgactgtaaaattagtgcttggactatacaagagggattttgtctctttgacttaaatacagtgttcagtgtttatggggataaaaagtagtcaaactaccaaagagagtctggtttctggtaaagaatttagaaataggaaaagctaaggtccatggaaatgaattctctgaccttcagacttctctagccaactactgagtgagataaactgataatctataatgtatgctaaattttcagaatgaaactaaagtgcaaaattgaattgtacgaacaatagacaccatgaagaattaaaaggcttattttttaaaagtaactccagtgaataacatagcccaggcatagatatgcttgccaaacaagcaattgacccagtaaacaacatggttattcagacaaaatcagagatcctgtatttgtgaggtcaatagatcaaaatttttatcaacttatctattgtctctatatattcacgtatacatttttgaaaaatatttgttacaatttacaaaaacacatatatggcaatagaataaacaataaaaaatttagaattcaagatagttgactatgcatgtctccaacctcatatcccattaaatgacataagatattcacaaagaggacaaaattataacaccactagaaaagtatagggagcttgtgtttggcagatctgaatactgaggaatttctgaaagctgtaaggcagatagcaacacattgactgagaatatcaaaaagctaaacaattcataacacaaaatggaagaaagaagaggctttctcagcaaaattctgggggactccaagatcagggggcagagaaaggtgagggatgactgaataaagagacctgaaagagctgtcccgttcaaaaggctgaccccacgtttgtcccccaagcaaagctgaaagaatagcttcctgaataaactggtgaatcatctgtgagaggtttccagagtgggcactagcattaaaaaaattgcagcactgaactcccaagtaactttgattaccataatgggctactaaaggataaagtgtcatacctcctaaagaaaagacttcccagtgccccaatccctgaaaggagccagggcttctgtcttaagaatttatacccattgttggagatacaatttttttcatgtaaggagaattacatttcaggaaccaattctattttcttagatcctgatttataaatgtaaataagtaattttattcctccaaaggaatgccaccctgttgacatcttgattttagccctatgaaatccatttcagattctgacctctaaaaaattaaaataatgaatttgtgttgtttgtagtcactaagtttgtggtactttgttacagcagcaataggaaactaatacacatggagaacagactcaatagacccaataactctgtagtgagaaatcacaaggaaagaaagagatacagatggagggtatgatgtaatcaaataaataatagaaagactgacttgaagctggaaagggacttgagttttcagagaagaaaaggccaactgagtcccttatggcaaaattgtaaaaaaattggaatccctaaggataaagaaaaatcttacaagctcccattaaaaaatacattttttggtataaatgaattattattctcatcactgagcccattatttatttgagctaagtattttactttaatcttcaccacaccaggaccctataccacactcttatctacttgcatgcggatatggaaaaagaggatccctgaggttatgcagttctacagttagtaagtggtagaaatggaattaaaagtcaagttcagaaacatgggattctgaagacaattacattatttgctagcatcaaacttctcatttacaatacagaaaacaggaaaacaacagaccaatgcctgtaaaaagttaaagaagtacgttttcaagctcaagtcctatcattaaagtatggggcagaggggaatgacatttttagacatacaagaacatagaaggcttaccacccacataaccttttctgaaaacaaagcaacaacaaaatcttcaggttgtacttcagcaagataaagttgaaaaacagaaatacataacataccaataaaatgagcaatgatatcagtaaaacttatagttaatactaagtaatggttgaaaatatggcagtgaaatttaatggaattgttaagtaggtagtcataaaacagaagaggcacaaagtaaaaaattaacaatctggaaccaaaattcaagataatttttaacaatatgaaagaggtagtaaggaagaaacaaagggaagttataaaataccaatgatacaacctgtattttgtttaagcgagattgttgtagacactgctttatttttatttggacaggaaaacaatttctgatttcggcaagtttaaggatgttcactagcagaacaaaaatgtaaggtgaaaatttcaaactactatgaggtaaactgtaaataaaaaataagaaattaaagaataaaaacataaaataagaatatatgagacaatataatgaatatcagttgaatttttctaaactattctagaaataggcaatgttccatgttatttttttaaaaaaatcaacttcatcaaggtattatttgcatacaataaaatgcacagatttttatttatttattctaagcttttatattgggttcaggggtacatgtgcaggtttggtatataggtaaattgcatgtcatgggagtttggtgtacaaattatttaatcagccaggtaataagcatagtacccggcaggtagttttccagtcctcatcttcctgtccccctctaccctcaaggaggccccagtgtctgttgttcccttctttgtgtccacatatgctcaatgtttagctgtcactcatcagtgaaaacatgtggtatttcgttttctatgcctgaattagtttactgaggataatgagttcagctctatccatgttactgcaaaggacatgatctcattccttttatggctgtgaaccaaggtgtataagtaccacattttctttctccagtctaatgttgatggacatttaggttgattccatgtctttgctattgtgaacagtgctgtgatgaagatacgcatgcaagtgtctttatggcagcacaatttatatatctttggttatatacccaacaatgggattgctgggtcaaatggtagttctgttttaagttctctgagaaactgtcaaactgtttccacagtggctgaactaatttacactcccaccagcagtgtataagcattcccttttctctgtaacctccccagcatctgttactttttgactttttaataatagccattctgactgatatgaggtggtatctcattgtggttttgatttgcatttctctaatgattagtgatgttgagcattttttcacatgcttgttggccatgtgtatgtcttcttttgaaaagtgtctgtccatgtcctttgcccacttttaaattttttttttaatttgtttaagttgcttgtagatgctgggaattagacctttgtcagatgcatagtttgcaaatattttctcctattctgtaggttctctgtttactctgttgatagtttcttttgctgtttagaagccctttagtttaattatatctgacttgtcaattttgttgctgttgcaattacttttagtgttttcatcatgaaatttttgccagagcctatgtccagaatggtattttgtaggttatcttctagggtttttgtggttttaggttttacatttaagtctttaatccaccttgaattgatttgatttttgtatataagtgaggggcccagtttcaatcttctgcatatggctagccagttatcccaacaccatttattgaatagagagtcctttctccattgtttttctcaactttgtaggagatcagatggttgtaggtgtgaagctttattttgatctgtctattctgttccattgttctgtgtgcctgtttttgtacttgcaccatgctgttttggttactgtagccttgtagtataatttgaagtcaggtaatgtaatgcctgcagctttgttctttttggttgtgattgctttgcatattcaggctctttattggttacatattaattttaaaatggttttttctaattctgggaagaatgtcattggtaatttgacaggagtagcattgaatctataaattgctctgggcattatggccattttaacaagatggattcatctatacatgagcatataatgtgttcccatttgtttttgtcatctctgatttccttgagaagtgttttgtaattctcattgtagagatcttttacctccctggttagctgtattcctaggtattttattcttttttgtggctgttgtgaataagatcatgttctagatttgactgtcagcttggatgttattgatgtatagaaatgctattgatttttgtacattgattttgtatcatgaaactctgctgaagttgtttatcagatctaggagcttttgggcaaagtctatggggttttctaggtatagaatcatattgtctgcaaacagagatagttggacttatgctcttcctatttgggtgtcttttctttctttctcattcctgattgctctagctgggacttccagtactatgttgaatagaagtggtgaggctggacatccttgtcttgttctgcttctcaaggggaattcttccagcttttgcattttcagtacgatgttggctgtgggtttgtcataagtggctcttattattttaaaatatgttttcacagtgtctggtttgttgtttttttaaaatgttgaattttattgaaagccttttctgaatctattgagatgatcatgtagttttttagttctgcttatgtgataaataacatttattgatttgcctatgttgaaccaaacttgcatcccaggggtaaaacctactttatcatgatgaattagttttttgatgtgctgctgggtttggtttgccagtattttgttgacgatttttgcatctattttcttcaaggagagtggcctgaggttttccttttttgttgtgcctcttcctgtttgtttggtcagaatgatgcttgcctcgcagaatgagttagagacaagtcccttctcctcagcttttaggaaaagtttcagtaggaatggtgccagctctttaacacatctggtagaatttggctgtgaattcatctggtcctgggctttgtctggttgataggctttttattattgattcaatttcagaactcattcttggtctgttcaggtattcagtttctttctggttcattcttaggagattgtacatttccagaaatgtatccatttcttctaggttttatagtatgtgtgcatagaggtattcatagtagtctctgaggttttttttaatatttctgtggggtcagtggtaacgtcccctttgccatttctggttgtgtttatttagatcttcttttttttctttattagtctagctagcagtctgtcaatcttatttgttctttcaaaaaaacctcctggatttatcttttgtatggttttcccatcttaatttcatttagtttagctctgattttgtttttttcttgtcttctgctagctttggggttggctggctcttgtttttcttgttcctctagttgagatgttaggttgttaatttgagacctttctaaagttttgatgtgggcatttagcactatgaatatttttcttaagttggaactgctttagctgtattccagagattctggtatggtatatctttgttctcgttagttcaaagaaaattttcaaagaattttttaccttgattttgttgtttaacaaaagtcattcattcaggagcaggttgtttaacttccatgtaattgtatggttttatgtaatcttcttagtattgattcttatttgattgcactggggtatgagagtgtggttggtaacatatatttttttgaatttgatgatgatattttaatgtcaattttgtggttgattttagagtgccatgtgtagatgagaaaaatgtatatactgttgtttttgggtggagtgttctgtaggtctctattatgcccatttggtcaagtgtctagctcaggtcccaaacatatttgttagttttctgcctcaacgatctgtctaatactgtcagtggcatgttgaagtctcctactattgttgtatggtaatctaagtctcttttaggtctctaagaacttgttttatgaatctgggtgcttctatgttgggtgcatatatattcaggttaggtcttcttgttgaattcaacccttagccattatataatgcccttctttgtattttttgattgttgttggtttaaagtctactttgtctgaaattaatatcaactcctgatttgttttccatttgcttggtagatttttctacatccctttactttgagactatgggtgtcactgcatgtgagatgggtctcttgaagatagcatatagttgggttttacttctttatccaacttgccgctctgtgccttttaattggaacatttagcctgtttacattcaattttgatatgtgtagatttaatcctggctttgtgtcactagctagttgttatgcagacttgattgtatagtggctttatagtgtcaatattctacacatttgtgtgttcctgtggtggcccataatggtctttcctttccatatttagcattcccttaaggacctcttataaggcaggtctggaagtaacaaattcccttagcatttacttgtctaaaaagattcttatgtttcctttgcttatgaagcttagtttggcaggatatcaaattcttggttagaatttcctgtctttaagaatgctgaatataggcccccaatctcttctgggctagggttcttgctgacagagccactgttagcctgatggggttctctttgtaggtgacctgccccttctctctagcttactttaacatttgtttctttcatttcaaccttggagaatcagatgactatttgtcttggggatggtcatcttgtatagtatctcacagaggttctctgtatttctcaaatttgaatgttggcctaacaaggttggagaaattttcatgaaccatatcttcaagtatattttccaagttccttgccttctcgctctctctttcagggatgccagtaagtagcagattttatttctttacgtaattctatatcccttggtggttttgttcatttttttctttatttttgtctaagttattttggaaaagcagtgttcgagctctgcaattctttcctcagcttggtcaattctgctgttaatacttgcaattgtattataaaattctcgaagtcatttttcagctctatcagatcaatttgattatttcttaaaatattcattttgtctttcagctcctgaatcattttgttatattccttagattccttggattgggtctcaactttctcctgtatctcaatgatctttattcttatccatattctgaatttaatgtctgtcatttcggccatttcagcctggttaaaaaccactgctggagaaccagtgcagttgtttggagctaagaagacatcttggctttttgatttgccagagttcttatcctggttctttcttatctgtatgggctgatgttcctttttatatttgatgttactgtcctttggatggatttcattgcttttttttccctttgatgcctgtgggtgtttgattgcggtataaagtgggttcagtcaactggcttcatttctggaatattttagggggcaaaggctcagcttagtatttctgggctgtatgctctaactctgggggcctggtacccagcccccagctttgttctctggtcccttgaggttagaaagctgctgtacaagaggggctgaggtattccctagccacaatactccaatagggggtgccagccaaagtgttttgttggggcagtggccatgggatctgtgctcactcacacatgccagcaactgcagcagcatcatggggtacacgtgttggctaaagaaaggtaccagtgggagtagggtgtcagtgttcctgcatgtacttgcactggcagtggtggtggtgtggcagggatggggtactagtctgaattttttaatttaaaggactctcagtctggagctgagattgcgccactgcactctagtctgggtgacagagtgagactccatctcaaaagaaaacattaggtacaccatggtaattttaataatgatgacaatgttgttgttgatgatagcagcagctaacatttattgattcctcattagaaatcattaggaacagattcaccctctcattttgtcctcacaacaatcttacaaagctaagttataaagttagtataagataatgttaccaagagtttaaaataaagtggagaaatggaaaaagcaagacagaaaattttatcttttataagggaaaacaacttactgaaaaacctggaaagaaatacagtatagtactaatagctgctggttctcaaaggtaaaactatgtgtagtttttcctttcatcttttctgtcttatttttctcttataagcccttgttacaaggggaaaatacaagaaaatgtatttaaaataaacagacgatgtgcaatttcatttctggagatgactaggcaatgttttttctcaaaggatcttttggggcctcgagaaaacctaggttagattttgctattcatcaggtaaaaatgtatttcctaccattctctgttggaggcaccatagcagaattcagcaaaagagaaacatggttatagattgctcagagatagaaagatgtctctgatgagtgataatgtaaagaaataagtcacctcaggtgtcatgatgatttatgcttttctcagtaaatttaattttatctttttttccccatttgtgccttacaagagccctgagagactaggacaccaggcattatcaatgcccatgttacagaaaatgaggggcagtgagcatagttacctgccaaggccacacaatgagctagtaaaaacctgaacacagaacacaatcttaactcttaactcagtgctttcttccatgacaacagcttatctgggagccctgattcctcttggcaggaaagacaagcctatcaatatatcagctatctaagatatttatggatgaagattctgtgtaatgtctgctgtaaattcagtttactacaactctcagcaaaatcaaaggaataccagttgtatcccaccttttactctgccattcatgcaacactcattgattgcatgcagagaactatgaaagtgttaggcattcagtgatgcttgtcttcgggtagcttatagtggggaagcagttaatcaaatctagaagtataacacaatggaatcagtaacgtgaaggagacataatgaagtgtcgtggctctcagaagagggacacgctgctcatcattcattgactcattcattcaacaaataaaaactgccttcttgttgccatgctttgtgttgaattccggggatgcacagttaatacagacacatgatatttatcctcaaggattatcatctagtgggaaacttaagattgaccaaatgattatacagacgtacattaaatcagaagtgataaatatggcaaaggatagttagtggtgtaagaagcatgtgatctagggtgagtttcttctgattcaagggtgagtttctttacagccctctactagaacatgagaaattttgtatttcctccaaggcttggctattcaaaggagagtttgcaggtgctgattggaagtggcttacttaatattgcttatatcctttattgtaataatctgataggctatttcttaccacactgccgcttccttttcctccttcacagccctgcatatagtagatggtaatcttcctgttctcagtttatatatggagtgtaatgttggactgttcctctttgcccaatgagccaggcaaacactaatggagagaaaactgcaatcatatccacagtgttcatagtaaaacattagatcccaacctgaagcatcctctgctgagggtagcagatggcatcagggtgcctatgttagaagtaatgcaaacctgattatactctttctaattttttcccctcctacatgaagcatgctgtagccacctcacagaatatggtgatgtgtcaaaacttaattagccaacacttgtaccccatctacattatgtcaaaaactacactttcaagaacaagagaagagagctccaaaatattctggcaggcagagaattcttagaacacaaagaaagagaataaggtagtaagctattttctattatcaaggccttaattctttcttggataatcagaaatgggagaaaattttctgggttccctggatgtaccagggttgccatatcttctatacaaaaatggaaaaatctatgacctgacatgtatgtgggaaacgtatggtctggtgtgcatgtatgtgggactagaagcaggcatgtttgaagtaaatacagtttctgtttatctggtatgcatcacagggtgaccaacccaccctgtttgctcaggatggaggggctttctaggatgcaagaatttcagtgttaaaactgagaaagccccaggcaatctgagataacccttgatgtatgtaatgtatggctcttaaaaaaaaaaaactcttattatattcttagaaggtcatgttgaccagtacagtgctgtcgcctttgttctctcctttgaccaatgtggaggaatgaggctgcctgcttacaggaatatcagagatctttctaattcctaaactggctcatctatccaaacccctcacccctctcccaccatttttcttttcctcaggcccagctccttgcctcttaatggtcatgctcacagctttggggctgaatactcaattagccactgcagcgcaagaagagtcccccagcttcatccatcctttatccatgaagaaggcccagagctccttttatatttgctagggatttttcaccagagtatagaaaaaaagtcacgtgatacacttttaagtcataaaaaggacaaaaaactcacaataaaaatatgcatttggaaatcttatatgcataaggagcaagttctagctcagtttgtttatatattaagttcatgcccaagagggtcaatgccttctctaatctatccctaagcccctttacctctattatttgcaggcttggtgagggagcctctatcctacgctgcttctgcttctcatgcctatcggaggcaatgcatgtaatacaaaccctatggaattgggacctctccagcttgttcagagctggttgaagctccttgctctgccactttttagttcagtatacttagatgaattatttaatcctctaaatctcagttcacttgttacattttcacagagacctagaaacattaaaaaatactatttacatgttcccaacctcctaaggtggctgcttcgtttgctctcacattcagcacgatagataattgtaaggcatacaagaatttcaaccatcaaaggtgtaagtaaattctctatattctcttcatgatgacaaaataagcagttgaatatttgccctaagattggaaatcaaaaagtttatccatcagtgctccataaattgcagttgacgcttccctgtggcactaagacagctgtcaaggtggaaaatggggcttaggcttggagataggagtctttgcgcaaaaggtttgcactgcctcaggtggagttaattctccctgacctcataggcccattgtaaagattaattgagaagtgatctaaaagtgtatgacacacagagtaagctcttgactgttggttaagttgggcacacttcttttctcctgttggcacaaggcatagaagtgccacatgctagtaagtggaatttctatcattttctggctctcctccttacctgcttagagtttatggcccatcatccctatcagtcctttttttttttttttttttttttttacaactctaccctttgctgctgtctttcatcaaacaaactcacctgtcattccttatagctggttggacctagctctctgccttctctgttcttatccccaggctatttaatgaatctggataaagatatacagttatcatttcatctgtaaccataaatctcaagtgtgtttcaccattctcccacattactctagtcaactcacgctcccacattcagggctagctattttattatctgccttccccatcacccaaatttccaattcccgctcctcactctcagttgatgaccttgattctcatttgagaatataaagcagggctactttatcctcccacaaccaaacctacttccccagctgtacccacacagaaaccctcctctgtccctccagttatgggggtaagctgtcccttcacctgctggtggccagcacctcctttcttggataggatcctacattatcttgcgtggaggaggacttgacacctacagagactctgtctttccttagcatcaccagtgaattggattattcccatcagtacaagtatatcctaatatgtcctggattaaaatatatccttattttgatccctatttctctctagctagcctacccccattttgtgctcccttttatgtcaaaaaatttttaaatagttttttatactgtcttcgctatctcattctatattcatttatcaaccttccaagcaggtttttccccccggtattccactgaaactgctcccatcaatgatttctgtcttgctaaatcaaatgatcagctaattgctctctccaggaaaaaactttgttcttcttttggcttttatggcaccacactttctggatgtccctcctttctcaccggatgtgccatctcggtctccattgctggtgccttccctgcctgccaatctctaaacgtcaggataccatagcactcaattcttagccctcttttctaactacattcactccctggatagtctaatgtatgcccatggctttaaatatttgttatatgccatggaccaacaaatttatatcttcagccccactttcttagtttccagacatgtattttgcctatttgacatttctatttgcatgtttaaaaggcacctcaaactcagtaactccagattagaattcctgatctcccatccctgccaaagtccactccttcctcagtcttctctatctcaatatatcaaagggccattcactcaatgactactctccttctctcacaaccaatgtccaatccatctgcatgtcctgcttgccctacgtttgaaacagatattgcactacatcacttatctgcaccttgcatcaaccatgtcttatgtctcttccagatgacacagtggtttcctagtgttttgtttccatccttaccttgtacagtcagcttcacacagcacacagcagttggagtgatctttcaataacctgtaccaagtctttccaatatctattgaaagctttctagtggttccctgtaacatcagcattaaaaccaaactcctttccatagcctatgtggctcttgacaatcagacttttgaccatttttctgtaacctgaattcgccctctgctcactgtcctctgttcatagtgaccttcttcctgtttatggaatgtgccaagtctgtaccacctgatggtctttgagcagctgttctctttggctcaataatcaacttcctgctgttcacttgcttactccacttaggttggctcaaatgttggccatttgaggaagaggaaggaagaggttggctcctcttccttcagtggggccttcccggctgccccatctaaaatagcaaccctggccttttttcattctgttttatttattaacttaccacattaaaaatattttacatatatatgtatatatgtgtgtatatatatctacgtactttattggtttaatatctgttcctgaccagatccctcttcgaggctgaaggacttattcccccaactgctgggagttctcagtggccatctctttcccaggattgtctttagctgataagagcccctgtgcaagatcgcacctcattcccagtgagcccacagtcaatgactgacctatacacctgtctaaagatgagggttccctcgccacaatgggggaccattttgaagggtcatcccagtttcagagctttccacgaggtcagcttcagcctttgttgagcctgcttcacggtccattccttctttcttccttttccccgcaggacttaagcccaagagccctttccaatgaacttcctgtgcacaatgtccatgtcagaggatgtttcctggggaacctgatctgtaaaaccttcatgaaaacataaggttcaccagtgcttagacctcatctgtctaattttcagttatcttcccagagcctaaaacagtgcctggcacatagcaggtgttcaataaatagtgagtaaatgaatgaataaagtagaagggctgggatcagacccagtcctgtgtgatctcaaaggcactgtgttctctgacccacaaacactaccatccaggcaattccaacttacaattagaaattcagttccatttgaaattctgcccttgcttctgcatgcacctggtaccagatgaaacttgcagttagttaaggcacacagattaattgaaagaactcattcccacaaatggtgaccctgggagagctcatgcatggcagtgtaattactttggtcatattgacacatcaggagagcccagagtcaggctcagcctgaggtttccatctgaactttgcatttccgtaggcctctctcccttgaagtcaaatgacataattttaacaaattttgagtgtgtgaataatttcttcttttcttctgccctggtatgtatactgatattaaagactagaatatttatcatgttggcagttcctgcctgctagatttgattttgttaagaagccgagttttcctctgacagcattcaactccacatcttcttattcttgacttccactttagacactttggtattagctagctctacaccaaaataaaatgggagggagccaataggaatagctaagtatactgaccacattcattcctgactactggggaaacacaaatccagttactaaataaaaagccagttcagataaggaatgatgctatatcttccaaatgactcctgtcgcattcactggattaaaacccagagcgtcaccacttatattccagtgatgtatttagtaccctactttaccaaatcactaggaaagccatggactgtaacatctgtccaaatgcagagagaatcaaactctgattatgctaatctgatatcgacacaaagacattagtaaaataggccactctcactgaataaaatgtccttggctttcataactgattttttgacgtcatctggttttctgcaaaagccagagatagagctgcttacatttcagggaagactgtacctccagtgaaaacatgctccagcgcacatgatatttcaaagcagccgtgctatctttccatagccactataaatgtgcaggcacttcctcgtcacaggtgagatagaaggtgaaaggtgtactgagatatctctttcctagcctctgttaaagacaaaaaaactcattttttccagctaaagcaataccaaagatgactggatgtcatccctggttctgtagaattacactgaagggggagctcagagttctttggaactggaggtcaggcttgcagaattagtcactatttatctgaagaccgagaatccagcttgttaccatgatttcaaggaactgaaagccacacaagtcaggtgaaattcagaggtaaatgctacaaatttgaaaaggggaagctcagtgtcctctgctcttttttcgagctattttgagacatgggaagacactaaagaaacatggcaagtattagaaataaaaagcaatcctttataagaacaaaattacagtgttgagatgaaacggaacctgtcaatttccaatcatctattcagaggacaaagaccccatttcagggaatcttctacagatgttcttttgatagctttttatttaatagtcaactggaggctcagctttttataatttagtttcccagaaaaagcatcctattctcttagatcatttagtacctctgagatttgcagtattcactcttccgcaatatttgcatctcatcgatgttaactgcagaaagtaacaagaatgtcgagaaagactcctttcttcaacagcctgcctgccatcccataaccaccttctctattttcactgcactggctcttttaaactactgcaagttcttccactctgtaattggaaaaatttttcgcttcaattttaaaaattatagacatgtaataaaatgttgccctgcactgcttgcttaatctatctgctcctcctcttatcgtcatcgtttcttttcacatcctggtgactgaagctgtttaaaccagatgcaccatgagaagcagggtaataggaatgaataacagaaggggaggctcatgtccttttgtgggttcatcctggaaggtggggggaggagaggcttagagaggggcatggtgagagggcagcattagagacaatgtactcaatcccccttgatcctgcccttaagctctttcagaaaacttaatctccaaagatttagtttaattttgattataaacaaaatatccttctaccaatggtaactgataacaacgaaagagcagggaaacacaccagctgatgtccctcttctgaatcagctgttcctgatggtgcacagcttcacttaattgttttgttcttccttctaccctgcctcattccacaagagttgttatggcttacaggataagaaaaacatattgtatctaacattacgtttaacaacaaaaacaacaacaaaaatcgaagcagattaaagacaaattcagatagaatggcaggatctagagtaattcaccagtttataaagttcctctaactttattacaagtgaaaatttggttctgaaggccttgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaaaatggaagtctagttggtctataattaggcactaatcatctgatatgatggagatacctctgcagaatctgtagaattttgaattatctacttgtcattttctggggaacatcatagaagtgataatgaaatcactcaaatttctggatattcttcaacctagcttggccatcctagtccaaaaaaatataataagcatttatcaagcaccgacaaacaatttcagtgcatattaattgggcacctactatgtgccaaataatttgcagcctcagagataagcaaacagaccattagacatggttaaatgtatgacaaattataattacatgagcaattactttagtaattcatgtaaattactacacttcatgaagactaacaagtacagatatcacattctataaagcccacaaatctagcacctatttcaccatgttatatgtagcaccgttacctcttttgtggactaagtagtatagcaaacttgatggaataaataacaccgacttcaaatcacaagggtattacatgagtagcctctactgacataatttcaagggtcagctatttctctgtaaaattaaaattaaattctgaaaacactatgtgctaggcacagtaatgggagcattccaataagctgtaatccttaccaccattttaaaatattagctccagtctacaagtcaggaaggaggctcaaggaggtaaagtaacttgcttagggacccctggagtccaagtgcattccttgttttcatgcatcctgccaacttcatagtttatttactgtgctccatatggtgcagtcactaccaagcaaatggcaatgaaaaagaaaaaaagaaaaaaacttgcctgccatttctcttcttcatagctagtgaaagagtttactaacatcagtgtcaatgatcataaagctaaaacgtcctaagccttaaatttgcttttcaaataccagtatttcagaggcagattacctgactccaataatatgcctcaaaccttgcactgtgtgtgcaatgaaagggaatattttcatccattataagaggctgtcagaggaaaacattttcctgatatcatacccaagagaacagcatgtgaagcaacactatcatattctaccgaactttcatatactccatgcagtacaatgtatattttatcttttgaaaagccttggtaacaaaaggataaaatatccatctaaaactcaaagtacattctaataatgctgcattcacattaatagcattcaaagaatctcatagccttctgcaggcagttcacttgtctgtgctaagaatctatccttcagttacaggaggaaaagctcaacccagtggctttgcccactctttatagctggggaagaggcagaagctaaggggcagtgtggaaggcatccattaactaagtcttcctcctgaatggcaggctagtgggaggaatttctttcccgtgcacagggagttaagtcggagctgaatttgcatatctctttagaatcacaagggtattgattctagcctctaagacatttacataaaggtttcaggacactctcaggaaatagcaaaggaaactttggaactgagagtgagaatccccagaaaagcaggggggaggaaatgcaccaatttttggcagttgaagaactgaaggcagggtgagtctaaagacatatatgcctaggagagacatctttgtgttggtgactcagtctctgagtctcacctggtgcagttcactcaaatggtatcctagcaagtcttcagggatcctgttttaaattgtttgtctgagatttttgtgaaatttgggaaagccatgccatcttctgggaaactcgaaagaagactaaagtcccttcaaggtcagacctttcaggcttgggaacaatttatttgctttggagaaataccactgtcatgatgggagtagctgtgtcatgtttcagcagtgcttgcaagagtggagtgttagagaagtccgaatgaccgcacctccccaagcaccagcctccaaggaaacatatgtctcccaggactgtgcagaagggatgaccctgggaggctggggtaagctggcagcaacagtgtttggtggggatgctgagccaaataccattgcaatcaaagcctttgatcatcctcttgttggtgtgacttgggaactgagggtcacccttgaattcctttcagtcttaacactgaactaggagaagcacaaatcttaaatttccatctattaccattattattatccacagagaactgagggcagcctgagaaatgaatggcagagatgtgtcagctttgcccctgttaaattatgcacatcatatgaaatgacttaaaggatgactgcctaggagaaacagagacaggccatttacactggccagtcctttgaggctcatgactttaaaagttattcctgatccactctgagccctgaggaacttggaaatgtgcctattacggtttccaaagtgcaatcatgcttttggggtgaacaccccagctgcaaaaacagtaaggtctgtcctcatttcacagtaagagacagagccaggaagagaggctgcagaggagacagagagagcaccattgccattttttacagagaaaaagcatacatatcgtgacctagaaattaaaactatgtgttttcccctgactctatggctgccagaactgcttcagtgatgacaactatcttgggcattttatgtgccatttttttgatggaacgtgtaaaaaaattaactacccattcagaaatgaaattcactatgtgatttgccaccttgccagggaagagagcaatggtcagataacaaaacagacatgtaacaccactcctaaggataaaatacgtatagtgctagagccaaaacaaacaggctgcagagatgcaattaataggctgaaatatggtggtatcagagcacccaccatccctcatgctctcaaaacatggcaaagagaaggaaattggctgaaggtcagggctcttctgacccatgctgccttcttcctaagcccttgatatagatggaatgtatttctcccctgtcttcagtttcagtgcaatgttctgtaaaggaaaccagttttggagtcagacaacctaagattgaaactcagctctgtttcttgtcatctctgtaactctgggtaaattatttaacaactgcacatttcagtttcctggtttgtaaaactggccatctgaggtcatttggggaactaaatgagataaaatatgtatgtataaatggcagtagtaagtactcaatatatttagttcctttcccttttttcatctatatgtaattccaggatctggggtattttagaattcatctatttattatttcattcaataaacatttattgactgctttctgtatattacatactttgctgctaaccagatgctgacacagccataaaaattagtgggccaaaaggaacccagactgtagattgaaaggggtcatctttatgcacatcttatgcctcatatctgttgatgtctcaagcatcctacagggatgttacaccatccacgtaggaaataccagatctcacggtaatcggcaaggacaatttgttcgtcaaaacagattttgttgctcccacttgaatgcctcctttagaagtctctgttattaattcacctctgaaaggtgatcaacaaactcttacattcttccctttggttaatagattgattccgatctattaaaagtcaaattaaagttctcaccaagtgtgtaatcctgggagtttgtgtaacattcagctttcccatgtcttcacaattcttttaattttatatttctaatcacagaggccaacaacacagaacagtttgactatattaataaaattacttatttatatattatctgtgaccacttcctttcccccattacattcctccaagtggataacttacagttattaactttcaggaggcccctatatatcatagcatcataccattaagccttttggaaattcatcacaaatcagtatacagatgacattgatgtcttattgctattcattcctcccgggccgtttttagcagttcattttttatatccctgcagtgcagaaatatggctcactccagtatctgtcctttttgtaatcgcaaaaggaaagcttggcagttgtcatatattacactcttgaggaaaatgctagtaatacgtcgaattgattgaacagcatggacccaaactgcttggcatagggctatttcctcactgctattaagattttggttaaaaaaaaaaaaaccttaccttttagattcagaaactgtgaatcattaaaaggcaatttgtagaataaagatcacatacttgaagaagcctaaaagctcccctctatttcctctctttagattttgaacgtatttccagcatgcattcacattgttgcatgctacgctgctggaaacagtgtcattggccagaagctggttgccacctgggttgtgaaatagcccaggacttcccaggctctggaggggtagaagcttaaactggtaaagaagttgagaacattgtgactgcaaaggcattaggcaaaagccatacctatatgccatccttatcattgcaaaggtgccactagaaggactatggtcttggaggaggcaagcaaagaaagaagattgatatggtttggctttgtccccacccaaatctcacctggaattgtagctcccacaattcccatgtgtcatgagacggatctggtgggaggtaattgaatcacgggaatgggtctttcccatggtattcttgtgagagtaagtttcatgagatctgatggttttataaaagggagtttccctgcacaaattctcttgtctgctgccgtgtgagacatgcctttgaccttccaccatgattgtgaggcctccccagccatgtggaactgtaggtccattgaacctcttttcccttataaattacccagccttgggtatatctttatcagcagtatgaaagcagactaatacaaagttgtattaaaagaggaattaagatgaaagtaagaaaagtcatagctccatataatcaagcctatgctctcccctgcccctcatctttggaatgaggtagtgccaactgggcctgggggacctgaaatacagggcacaggcagttccgttggaatcattcttcaggaggccaaaccatggccaccggagtcctttccgatatgaatatttgtaactaatctgaggctttctttccaacaccagctacaatagttggtgatccacctgggtttactttttaaggccactagacatgtcccccagtttctattaattttgactgcaatcaactcacctttcttctgggaattgcccttgacctctaagaacagtggtgtgctgtgtgctgataaatctctatcatccagctctccagataaaaaagggggcttatatgtagcatttgcagatttctgtggtgttaacacccctaccatggtggatttcaagtcaccaccttgatggcacccaatgtggaggtgggaatagatacacatgatgggctctgaaaggcaggataagccagctccttaaggataccactgtacaggagacaccttgcctgggaataccagggaagagatgtgcctttcagaaggtactgaaggctgcctccctagaccctaggagtgcatggcaggatgagagcactttggtgttattcacgcttaggaggtccctgtgtatgttaagctgttcttgcattgttatacagaaatagccaaggctgggtaatttataacgaaaagaggtttaagtggcttacagttctgtaggctatataagcatggcactggcatctgcttagcttctggggaagcctcggggagtttttactcatggcagaaaaagtgtcagcagacaagtcacatggcaaaagcaggaacaagagccagtaaggaagaagatgccacacatttttaaacaactggacctagtgagaactcactcacgagtacagcaccaagaggatggcactcaaccattcatgggaaatccacccccatggtccaattacctcctgccaggccctaccttcaatattggggattataattcaacatgagatttggagggcacaatatcccaactatattactgtgggatcaggctatggttggactccagttaaactatcatctttgctgaacttctccccaggcctacttcccccattccctggcagctttcacgtgagaaacttcttcagaaaattatttgcataagaattctcatctcaagctctaaacctatgcttagacagcatcagactctggaagggtgacacaacacttattttgaacagataattttgtgaaactcttattctatttgaatttgacaagctcagaataaatgacgtgagagtcaacaaacactgaattgatttctgtattcaaacctacctagcaacgatgcattaaatagcaacatactaagtataatgtgtattcattttctccatcatagtgcaagtaatgcattttgcttatactgagaatagtgaaaatagctacttggcttaaaaggaagcaagagtggcttttccttaacttaaaaaaaatagtttctgaatatttcagaggaaaatgcaaattgagaaaaatctctgctccttagatgagatgtgaaaaatattcttgataggaaggtggcagaaaatatttttaggcagatgagatgctgctagtttgataggtttctattagatataacgtaccaaactgtgtgcgtgtatacattttcacccactggtaaaaatgaaatcatgtaccttcatcttatgatattgtatgtaaatgtttcatgtgggttagagcatgcatgtttcagagctaagggccagaatggactaacatcctatcaagtgttacatctgatgaagatctgagtaaaaacacaacactaatctgttcagaacatcaggtgggcaaagataacattaacaaaataaaactctcgccttactgaatagacactgggtttgctctatgagaaaaacagatattaggctgaatggcttattttcacattatttgcagtttggattttggccctagcatactacagagcaaggaactaaaacatctaactttttaaaacgttaagaatatgagatactggaaagagatggattattttagttattcttaatctttcgtgcaacattaataaagttgtatctatatgacattaaatcttcatcagaaaaattaagtctgggagctgctcagatgttcaactgcctacgctgcatagactcctcaaattgcattatttattccagtttttcagttttaatttggttcttttgtttcagaaaccaagcttagaagaaaatgagcattttcttaagtccttcaaaaagaatctactatatttcttttcttttctgaggtagtagatatattattatttatttttattttaattttccaaccaaagatacctggtttataggcaataatatccctttaataggattcaaagtgtctgaggtttacatagaacaactttgtgggtttattcaaatggtcaggcttacaaggagtagatcgaccaatttcagagccttcttggagagaatgtacaactgataccagctttttaagatcagcatcaaaagcttatcttgggtgtgtgtgactgtttctgccgctgtccaggagatctaccagtcttacctttttaactaatgtaaaaccatttgtctcaggctgcttgacaggtggagctagtctgtaaaacttagctcatgtttttttcttttctctcccatgtttagatggatggtaagagagctgagctgcaagcagtattatgtgaataacacattttgttgcctatgtttaagaggctggttgttttgtaaaatgcctgttagttgttctctttgtttgattgttcgtttgtttttgagatggagtctcactttgtcgcccaggttggagtgcagtggcacgatctctgctcactgcaacctccacctccctggttcaagcaattctcctgcctcagcctcccgagtagctgggactacaggtgcgcaccaccacacctggctaatttttgtaattttttagtagagacggggtttcaccatattggccaggctggtcttgaactcctgaccccatgatctgcctgccttggcctgctaaagtgctgggattacaggcgtgagccactgctcctggccaaatgcctgttagttttatctgtgggattatgtaaccagaaaactaaagtggtatgatgtgatggctactgaactcatgagattcctggaaaacattctctcttgtaggaattcatctgcctataaattaattaaacatctcaagctagtccttctataatttttaataaaaattatactcagttctgggataacttgaattttctctcatttaagtaccgtcactaaaattgtacaactgtcaatctttctgtgtttagttaaaatgttccatgaaagtggagaaccaatttcactcatacagaaaagagaaggcacatgttccttggtcatatgtatacagaaccaggagaaaagaggaagtgaaaggacagggaaagaaggacagggaaagagacacagggaaatgatgaaagggagggaggaggttggagataaagactggagagaaaagaaaaggctaagagagtaaaagagatgaaaaaatgagaaaaaatgagaagaagtatagagaaataaaggaacatgatgcaggaaagaagagtaaagtcctttctaatacccacaggaggagtaaagaatgagagagaattagagacacttatgaaatactaaagccaacaaccaggtgtttccttgggagatttgcctaatgactctgcattgattttctggatgatgtcaagaggtaaacattacaaagaactgccaagacagtgagcggcaatcctcagccaagatctaaactcagcaatggtgcatgagaacctgatacccacaacagaatgcttctgcactgaatccatttcccaacttaaaatacagcatcttagactttcacattttgcttatctttcatcacttttcactgctatgcactgaaatcttccgctccctgcaaaaagctctgctctgagtataaacacaactaccttgatctcattttaaaatctgtaatcaaaatcctcttttataacattcattttgctctgaatccttcattccagctactcagagtacaatataccaaaggagagagcctgtatccaaaactttgaggaataattttgatagtggttaataagaggacaatgcaagtttcttccaatgttagtgctttaaagggtgttttcctttaggaggatttacatcctagttaaatcttcattccaggatggctgcaagcaaatatattccacacgtcccatctaaccactgctcatacagaatcaaagtacatcaaggttggaaggggattcacaggtcaagtcaaagctctcatctgatgcctcattgtgttctacaatttcaagtacccctcagtgcccatcagaactctttctgtgccacgggtctccatgaaacagaaggtcattcaattttcacatagcttgaattcttattttgaattgaagtctggccaaagttactttcaaacagcagagctagttctcccctatgtctgagcctgcacagaaaaggtacatttaaaatcagctgtaatgacttcttaaaatattttcctttccaatagatgcatagacagagaaaactgaatataaaacattttgatttttcattactttcttcctcttcttctgtactttactgtgtcaatgtgttttctattagttaaccttactgtcagcactaggggaactgatgctaacattccagatactgtcttctcagtgaagggtattgcatgacaatggcctcacttgtcatggatgtagaacctcaggtactgtgtaattagactgaattcatctcttggcatttcccctgtgctatttactcaactgagcatattattcattaacttcctgtactttttcacatgtagtgttcttacagaatatgttgctcggcctgaatctgtgacattttatgtaaatatagtttgagaggaaagttttatctttatgccttttgggtttggggtactagcgaggtggctctgaattcttcttctgtcttccatagagttgaaatcacttcacctctctctacatatgctatgaattctaatgcaaacattagtttctctgacaaagaaattcaactgggagttatgttttcttgctgaaaacaaaaacacctgtgatggtagctaacagcatgttcttctctgccagtcattggcttgataacttgcattattacctgcctactaagtgcattttttcatataattctctccaccaccaccctgcaaggaaggtagaatgatgatgctccttttacaaatgaggaaactgaagcttagagaagttaagccaaataaaccctttgtttagtaatcaaagataatcttggttcattttgaatcaaccagcaccttctcacatttatctacgatagtgctggctagacagtagcaatctaaaattcaaactcagttctcacatctggtcatccatggccatgtattctctcccaaatggaggtatacattgtcttgcttatcctgctttcctctaaccacaactttttaaagtgctcctcattttctggaaacttcaacttgtcctgggcttgattctctgtgaaaccattgacaaatgatttctcctctggtcctccttggctctaagccctttctcctgcatctctacatgccatttaacaatattatttctcataaaattccccgtgctgccacttcgatatctttagctcctgccagttcctttttcggtactatcgtttgtgattctatcaccataatcttatttttaagagcttcccaatccactagagccatcttccatgaagcaatgagatcacatcaattttaatcatgatattttaaaaatctgccttttgaagttttcatatccatgtctgacaatgcctagctttttttctttttttaaccttgctaccattatttctaagataacacacctactttttcctagagttactgtccactccacatcactaagcctttccttgttggttagaattaaataaccagacccctatcactttctcctggaaaggatataattgatatgtcaataaaggaatttgtctaaccacaaaatacagatgagtaagaattgcatccacttcttcagcagctcttaaagatctgctgtatcccacaaacatacataaaattatacataccattttcatatcagagtttcagtgtaaaaagacctttggtgcttaaagacagctattgagttttaaatgggtaaggatacttatccaggaaaatttaacatcagttatccaataaaaaccagcaccacggcaacacatttagatgacaaaattgatcgacctttttgttttctttccaccttctgcatatagagtaagatcatctgacatttaagatcctcctgcaagttacatttctttctatctcccttttcatgctagctcatatcctacctcttccataaagtcttgtttgacaaacccaacttctcactctattaaaacattaatgccaagatgattgatttgctaattaatcatttcttaatatctataccgctattatctcaaatagttatttaaatcagttactgccatttagcttctgtgtgtctatattttctccccaaatatatcgtaaattttttgaaggaacataaaagcctcaaacataagaggtttcagaacatagcaatgtggacatgccgtgaatggcaatgattaaattttgcaatcaggttcagaggaaaattttaaaatagagaagtgataagattttaaataccaaaccaattcacatttcttattttttcaacttattttaatagtcataaaaaacataactgaaaattagttttagtaacagattctgtggatagcaaagttcttttccccatgggccttctcacattccccccaccttggatcgtagcaacttttggtgaattccacctaaacgcatttcttggtaagcaagggtactcttggttccattcaaatcagtcagcgctgtcatggataaccccaaggatataaaatgaaaatatgaaagcatgtttatcataaggagctcttaatctaagggctaatatctatagtatatttgtcttactattccttacaaggaaagcgatattaatattacaggccaaggttcagatcctaaaataaatataagtaaggtgcttaagaagccaaataaagagagatttcacagttagctaaagagatcaagaggaatttaagagatagtattggagccacagaggttaaaagcaggggttcggactccttaggcaagtggggtgaagggtatattgtggccaaagcacagatcccaggaaaaggagagatgcattcactttgtttgttttgtttgtttgttttttaaagtttacactctcactgggaacaaaaggtatgtacgaagtataatgcaaatgtctgtggaaaggagatttggtgctgtattacaagggctgtgaatgccaggctgaagcatttatacctgatttataagcaattaagagttttattagctcgtatttatttcatgggaaatgtggaaacttccatgtagatacacctatagctttgtgttggatgtcttccgatcgtccatttggatccatctttaccttgcttaggggcttggaggctggcttgcatggactgattcaacaagctcctttggcttctgccttctttccataagaggggaggaaaggagtgcagtcagagccttgttccccagctccacccttaggggttgccctgagctggttgcttccctcactgaaggtcaggtgttcctctccatggttggttcatttggtctccaggttctggtcctcactccctctcctcaccccttccagacctggggtggttataaacggtccctctatgagggatcctcatgactcaacatgttccatgtctcttgctgagactctccctgatataatccccaggtatccagaaatcaaaaggaaattggcgacaacagtagttttagcctttgctgggcaaaatttcaaacaaaaaacctgaagatatggggaaaaatcagcttctttgagataaccaatgtaggtcttcagtctgctgatggccagcttcttctcttttttgcttctctctctttctctgtctctctttttaaagatggggtcttattatgttgctcaggctggtcttgaactcctggcttcaagtgatcctcttgctttaagccttctggggagctgggattgcaggtgcaagccactgcaccctgcttctttttacttcttatattcctgactgtgccattaggctaaggtcaattatttctacaacctatctccttctcagaggtttcaagatcttctaccctctgtatcaggaacaggttgtattccaaaaacttgtactggatgtctgtgaaagtctgccaattcattagggaaatgtaaatcaaaatcacagtgagagatcacttcacaaccattaggatggctatttcaaaataaataacaaaaaaaaaaaaacaacaagtttctgtgaggatatggaaagattggaatccttgtgtgttgctgatgagaatgtaaaatagtatagccactgtgtaaaaaagtgtgacaaacctcaaaaagttaaacatagatatgccccagtaattccactccttgccatacacccagaaaaactggaagcagggactcaaacagttcattgtataccaattttcattgcagccttattcacaataatcaaaagctggatgcaacccaaatgtctatcgacagaagaacagacaaacaaaatgtggtatatacatacaatggagtattattcagccttaaaaatgaattaaattttgatacatgctccaacatggatggaccttgaaaacattatgctcagtgaaataagccagacataaaaaagataaatattatgtaattctacttatatgaggtacctagagcaggcaaattcatagaaacagaacgtaggacagaggttaccaggggctgagggggatggaaaatggggagttcttgtttactgggtacagagtttcaagttgggatgataaaaaagttacaaaaatgcatagttgtgatgactgcacaatagcctgaatgtactcaatgtcactgaaccatccactttaaaatggttaaagaaaaaatggctgtcaaatattctgcagcagagaccaaacacaggacccatatgaagaactatcggtagttaagaactcctagaaatgacaagatgatactgagagtggagaggaacttagaccccacagcattggactggaagtgtcaggagctggcttccaaaggtgctctcacaaatctaagctgctatgaatctgtgattagattcatttttattgtttccctgttgtacaggaaaaaggctgtttctgactataattttacaaaaatgccaaaaagttttaaaaataatttgttgatttgtggttagtaaaccagtataatctttatgttcacatctattattttagattccttttggcactgcaacaaattaccccataattagtggctcaagtgaactcaaatttattatcttatatttggggagttagaaatctgaaatcagttttgctgggctaaaattaaagtgtcagtagggctgtattccttctggaagctccaaggaagaatctgtttctttgcgctttgcagcttccagaggcctccttggctcatggccctgtgtcactccgacctctgcttccatcctcacgtctctgttctgattcggactctcctgcttctgtcttttccttttaaggactctatggttacaaggggtttgcctggatagtccagggtaaccttccagttttaaaatcctatatttaatcatatcttcaagataccttctgctatgtaaagtgacacatttagaagtcctgtggattaagatgtggacatttttggaaggggacattattctgtctaccacatttatcaactccaaatatattttcaaatgaaatggaaagagaggttagaacatacgtatttttcagattaccaaattaatgcaagtctgttttagcaaatctagaaactttagaaaagaaaaaataaaacagtattatccttcatcccagtctcttttttagatcctaccttctatacttaacatatgataaggatttgtcgtgtcatcaactaccttttatacttagatcctacttcttatacttaacatatgatcctaccttttatacttaatatatgataattatgtttagatcctaccttttatacctaacatatgacagatcctactttttatacttaacatatgataagcaattgtcatgtccttaactactgaggtgtctattttattaaatgagttaaaagatgagaaaagatgacggaactgagttttggttaaaatgatagaatcggcaagtgggttttagtctcagttttaatatgttttttctccttttagatattttagatcagcagataggtttctatgtgccatatttccttcctgaaagctaaactcacgacctttcaatacccacctatatcaaatcctcaaagcaaatatctatattccaaaataattgattgaagttatccatattttactctgcggtaaccttctcatcctgtatttcattttcaaattaccaagaatctcacttatgtgactatacactaaaattaaaacacaaacacactgcgtacactcactttggtctgagcaaaaagacatgaaaggtgaacatttttgtgaaattttacaagttcaatggctaacaagggtctcaatctttaaaacagtcagtgaggcttaactcagtgtaaaacatcatttatatcataatcaaacttcttcatatatggaaactttaagcaacctgaaaccacaaagaattatctccccaacctcctctttttgattaagttaatttagtagctttaactagaatggattaattagctccaaacaatgtagcaattggatgttaaatttaacagggtcaaagggtggagattggttccaaggtaggagtcttatatctacatacaacccagccttaagggcgtgccatttgtaaaaatacaattacagatttaatattcattatgcaaaatgtttgggatcataagtgcttcaaattttactaattttggatacttgcatatatctaatgagatttattggggatgggatccaagtcgaaacaaaaaattcatgtatgtttcatatacattatgtcttatgtagatagcctgaaggtaattatatacaatattttaaataactttttgcatgaaacacagtttgaactgcattttgactgcaacctgtcacatgaggctaaaaggtgaaataaatctcatttttaaataaaaatgaatattttctattacactcaaggcacagtgcataggatgagaaggaataactattattccttgctattcttgtactgaggttgaattttagccttaaactatggtaaggaaagcccttgttccttcatttgagcccaatgtcaggtcaaatatgttaaaataaacatagtaacgcaagtcaggggcttccagagagctgcatcacagttttgtgcataagatacacttgaacaccagaaagaataatgcttgtggataaaaatgcgacacaaaacatgtagttactaggctgcatttcacgtactgacacccagcttggctcagacttcaaaatgtgacatcttgcccaaattcaacaaaacttcccagtcttacagggtgattttcaaatcgattaagttgggtatttctttaagggaaaacaaaaatcagagcagtgatttgaattctcactttcaaaacaagtttccaactcattaaacatcaccttcaaaatgtgatacaaacatgatttacctattgcctagcaaattaaggcatttcattaccaattagtttatcacgaccaactatattttattttctacctttcacaaatgcaaaaggaaccatcagacagttctcagctcttcaaaccactgacaacaaaaattgtgccagatataaatatttacatcatgaaaagtaaatgttgccaagattccaaactccaatgcatttgaaaattggtttggatcaggtatactttcctgaattggaaagatacaaaatcatctgttcaaaaaatatctctaaaacaaaaaaaaacccaagtcataacatgtgagtgatttttaacactagactatctcccaatctcttctttcccaataaattttagggagaagctgtgttgacatttttttctttcacatcaacatttttcctttaagacattctgatggaaagtaaaaattatatatccattgtttgtgttagtttgacacattttccatctcaatcccaatctgtactttatctaaaaccccttcaaatgcttgccataactcgtaggcgaaggattcagctcccgaacactgcctcaggacctgccctctgctgtcctctctagcctaccatcttgcaagcctctcttcgctccctgtgttcagccttgctggctacctttcagctgcattctggaactcaggcaccaaaccccattctgtatcttgggcttttccaccccctgcttttccttttgcctagaatgcaattatcccctacatcaccctctccaagaaagaaagaatgactgaatatttaatcataactacaacttttccttcttaaatactgaccagcgaactcacacgtgttcacgactttaaataaataattcacctttttaaagagaaatgtacttagaagccatgacaagctccttgcagaatttataaaaataaaactataaatggaacaataattaggatagcatcgttttatatggaatcagagcaataaactaaatgacctatatatgacctttccacaaaaatgcttctcaagtcatatttaaaacagtacacaaatactgcataactaaatggtgtcgaccacatgcaatgtcttttaaaacctgctttgtgacctgagtcaaagtcacttacagctttttgatgagtcattaggggtgtgtgtatctgtgacagttacatggtacaagaaaatatatttcaatacatcagaaggggaaaaagttaacttacaaacttcatggtatttatggtgaacagactgcacaaaggaagagagaacagagcccaatgacccaaaccctgaagaatcagccgctggtattatcaaaagttgtcaataattttaacctcaattttttgcacacaaattattttccatttctcttaacaatagctaaattacctttgaacacaattttctgcatgtgcattttttttttacctttaacaacctactcaacagtaaaagatagccaagtagacatgaaccagcaagagaagtgctaagattccagtgatgagaagacccaatgggcacttgtgcccttccacaaattaaagaggagctcgttatggggggaggagagtgaaggagggatttaggtgtgagaatcacaaagcccagctcagcatttctgtgcaggagctaggattcttagcaagcaagatgcccctaggaagattaattattgattttcttataaatcatctaaggtgatttttgtctgtttttttcctcccaagatgatgaacgtctgattttatttttgttaattggttttctcacttcactgaggttaaaagaaggcctagtaaagcagtttcttagaggaaagattttcccagcatgataggcaggggtggccactatgctttctgtcctttatgggggtaccaaggttgtctgataagacttcaggcaacctccaggaggtacagagtaatcagaagcacaaaagtttgactagttagggagaaaaagcacaatttagacatatttctatctaatggcggcaggtctgaagtctgtggtattcctaggtgggaggacaaactcatcacagagactgaagccttgaggattagctttcagaatcaagatggccccatcttcaactttaccatggaagcaatatggtggcttaccttcctgccccccgtgttgatgcgaagaggtgtcagaaaggggtcgaagatcatgtgactggtctctatgttgactggcgactgccgtttccccacagagcaaagattccaagctgagttcaccaatccccagaaagaaggaactagaaacaaaaagaaattatagaattaggctgagtagcaggttggggaaacaacataaataaacagagctatgtacaaacgtggtaaaatggaagagaaccaccaaatgttcccacccatggagatccttgggggttgctatggtattttcctggtctgaatcttggtccacttctctaagtcttacctgcatggtctcttgtcatcagattttcttgtttgaggcccactcatcctgcagtttctttgttgactgcagtcatcattaacactttaatgctaacatcattgttcaggtctcatcatctttgcaatatgcctggggtagcacaaatatttagcaattccctggagttgatgctgtgcttttcctatctggcaagaacgatgtgaaaatcaaccttatcctatttggaagtttttcaaggaaagtgtcattcagtgtacacaaagtttttctttgggttgtcaagactaaactgagggagtgacttattttatgagccccctaatcaatgccagacaagagcttagcaacttgacttcatctttgtttagttcaacactgtgtcattaacctaatgtacttgtagataaagaattggtgttcatttgataggcagaaaaatgacattaagagctgagcacaaatacccaaaggaaaccgtccactcattttcagtgtcacatgaaaacttctattagaatgtatttctgtggcaatttccagttcgatttctctctatttaagaaagttttcagggcaagggtggggagccaacctactaattttatatcagtgaagatcaaaactatactttcagcctttccctgcccctttcagtacttccatcgagtctctggatccatgtgtccttcagattcccctgagattatatggccattcattcatccacccatagtacatgcagtgaactcctatttggcatcacgcactgggttaggctgaatctcgaggaaggcaggtaagcacaagaacaactaacacactggggaggctcactagtgtgaggtcgagtatgttatgagactccggatgaggggaagccaatcctgccatggtagaggggaggcagggagtgactcctggagaagatgagcctaacaatcacattagccttcttaaatggacctgtcctctcagaaactcaagtttaattaaacttaaattgaataaaggctttaacttacagtagccatcattcttgcctatagcatagatggagaaaactaaggcaaaagaggagtttggagacacttgccaaagatactcaaattctttgactctcttatttgttataggcaactgtaacagacatgggaggagaactaaaaataagttccttggcctagacaaacacttcaacatcaaaataagatgggtctcattttaaaatatgacaaatatctaatttggtttcatccatgccaataagcctctggtagaccatttcctttagtttaaggagtttgaattggctttttagtcattaatgactttcaaaatggtagcaatggcctgagttacagagggagaaagaggaggaggaggaagaggagaaacattgacacatgtgcatgggcttcctcggccctctcatttcttatcatttcttaaaatatgttatcactacaagttactccacctttagaaggtaccacgtcctagcaagactacaatatttaagaaagttcttgcattatgaatgcacttatattataaatataaacttgtcttttctaaactacttttttttaaaaaaaacactgacttgatcttatatttatttatccctcaatcatctcaaattatgaaaataaagccttcattagggcatcctcctagcagtctttgtccgtaacgcacacacaagtggcaaatgtgagcatgccagggatatagtcatggcacctccacaagtgaactgagtggcccttggtaagtcatgtgtcccttggaccttcttcatggttcctgtggtaggccgaatggctctccaccaatgatgtttactatcctaatcctcagaacatgtgaatatgctatcttagatggtaaagggtattttgcagatgtaattaagttaatcgttttgggatggagagattatctaggattatctgggtgggcccaatgtaatcacagaagtctttataagagaaatgtaggagggtcagagatataaagatatacagatggaaacagaggtcagccaggagagaagataatactctgctggctttgaagatggaggaaggggacatgaaccaaggaatgcaggtggcctctagaagctggaagaggcaagacaatggattctccacctagagcttcctgctgtaaggaatataggcctgctgataccatgatgtttaaccccttgagaatatatttgacctccagaaacgtaggataataaatttctgctgttttaagccatgcagttgtgatcatttgttatggcagtaacggaaaagtaatacagcacccctttacctttaaaactctgtgagacaataacctctttgacaatgaagacatctatgatgcttgcagggctctccctagaaggcagctgcatgattaaagtagttacagctggtgcacattgcatttcatctactcccatgaaaagcattaacaaaaataattccaagcccataaatggattataagactgctattatgtggcaacatgggtgggcagctgctgctgtacttcactaataaacgtcatgcccaaaaagtacccccgcaaaaacacaaacaggaaaaactttatgcgaacatctgccttctcttttattgggcatggaattctttatgacgaacagtttcggggttttatatccccacttcacgatcaaagcctgcgtctctgatgctaatcacctgctcagccaatcgaggaagaagtgagaaacctctctcctgctcagctgtgtccctcattggctccagccctgaactgctatctaagtttatttacccctggatggctgattttaaatcagctatgaattaatagcttttcagaaatagaagccaccttagagatcgtctgacttaaattcattacatggatttaaggccatagaggcagggagtaaagtcctccactctaggtcacacagccaggtagaggcgaggaaggacagagtaaagaacattactcaagatttccagtgctactgagcctctgctgctctaaaccccttcctctccagcaggctctatacatgagcagatcattttaggaaatttcagttaattgctgccaagacccctgtaagacttttgctatcatttctcttttggtaaatcaagaataacattagtgccaattttccagttaaaataaatttcaagtgcaaaggtttgaatcaaactgctttgaaagtcaactattctaaataaacttaggattttaaaggagccatacaaccatggagtaacatacatagaagggcctgggtgtgaaaagacttcagttcaggcgatgtgtttgggtcccatctgcaggcctctgaggagacctgatggggatgattgcacacaaagagctgctccagggatagttcctggggtcagctgcaccgggcaaggttttagtgcagataaaaatgagaagtcagtgctgttaggagcggtgttaagtgttgggacaataattaagatattgaagctagtctagggaactcaagtgccgaatggaccagactaggtctgcaaatgtggtgtaatctagattctagggaaatggtttaggacgaaggctgtgaaaacaggcgtccatgaagtgcctgtgcctactggggcatgggagtcagatggcccactttacatgcagagcaaggatgggcgtatgaatgaaagcttcaagatttagagtgagaaacttgccctgtgggtttgtgcagaactgtcagttatatccaaggttctgatacttaactacccttcatctacccttcatagtgttatctttcaggtttatagacacccgtgtcaccttttggagcaaaagtgggttatataatgctgtggcaggcactgcctctatttccaaggtaagagaaatattgttgaatttttttctcttagtttccatggctatcctccaaaatcagatgtttaaacttttatttttaaagcatccattattatggcttattagctaatgctgtgtctttacttgatcaatacaacttactgttgagagaaaatgtaaataaagcaaaatagagtaagaatcactctaattaatggacaaccagtctgacgatgtttgaattccatcatccttggcatcctttttgtacaatcttctaatttacatataaactagaacacaaaacagacccaaatatttttgcaaattaattttcacacagcctaaaccatggaacttaactgctgcatcacagcgatgtgttatcttgccaaagtatttcccaatggcactactgccattcttaccataaattacaaatcccaaacgttctcttggctctgggtccagtgagttttgaaagatgctcagtgactctgtgatttcaactgcttaaatcatgagccttggcaaacccaaagcaaaacttatcagctgcttgttcagacccatgaaataaaaaagctccagctgtttaataacacaccttggcaacgtctggacaaaaacaacaaagttttcaccaaaaacaaataggtcagaagagcaaggaaccagaggaatcaagtccgataaggagagttaaaactggccttgacttctttgtcctagagaaggtgttccgaagttagattgtgcttttaggcatcttccttattcatttgtcctaagccagcagaatttgctgctgtgggcaggatattaggcacttggaataagtttatacagcttatgtgaatttgctaagtcctatggcaacaagataaattcaattcaaaagcatttactgacagcctctgatgtgccaggcattagggttggcactgaaagttgatgcaacaaatctttactgaggacctactatgtgtcaggcactgccatcagttctgggaagtcaattatgaatgagagatatggttcctattctcatgaatcttgcaggctagtgggaaatatgggagataaacaagtttctatatgtctatctgtgtaaagtttttggtaagcatgttgtagagacaagacggtaatggatcatagcttaaagcatgtatgggagagaaaacctaggtagcatggtcaagggtggtctctctggaagggtcagctggtagactctggaaggactgggaaagttgcttctaaacagtggcaggagaaaggatgtccaaggcagagcgaaagtgagcagtcttggcagagaagagctggatgtgttcaggaacagagaggaagtcagtcgacttgagcctgatggaccagatgaggagaagagcgaaatgagatgggggctggctgggtagaccaggaacagatggctcagtgctctgcaggccacactaaggagtttgcattttactccaagttaatagaaagccactgagagtttagcagggaaataccatggtctgattttttaattaaaggcaggtatctgcctcagatggaacacagccaagagcaagctcgactatccttgaagtagtttgaatgggaaaagaattggttcccaagcaacagttggggacataggtttttaagtgaatttaatcctattgcttttggtgtgtttaaattctatttcaaaggcagaactaattgaatgttttaaaattattctcttcaaaatatgtgccaataaaatcgtgttttcctaggaactagtgctttacaagccattctttgaagcaaggaatattttcatgaagacactcagctaaagcaatcttttctcgttttcaagcaataaactaagtcccctactttttggtcaagggaaagcaaatgaaagttgggaaaatgaacgctggcataaaacatatctctagtgaattcaatcctacagataaagccttccacttcaatatagcaatctctactttggggttataaagcatatgaatacattttaaataagaactcatatctttcccttgctcttttcctcaccaatcctgatttactgtctcttcctctcttctcaactgtaataaatctccactttgagccattattaatgagcaagtttaaaatacccactgctgcaggcttttggtctgtttctgatttgatttatttcatagatggaattggccttaaagttaacccctttgctgatgatttcttcctccattgcagggcctctgactcatagcacatggagggtctttaactagggctgcccattgttaaaggtaagttctcccattgagaactagggctgtcacttgggaacctctaaggaattgcatatatcctatttaacccataatcattaatttgtgcattcatctaaaaaattaatggactgtatctgatgaaccagggatagaaagataaatcaaaatgctcccactcttcaggacactcagtatggtgggaagatagacaagctaacaaatagttataacaaaatatgatagatgttataataagggtatgtgtatattaaggcttaaattaattcagagcaagaagcaagctgacctggcccttttctcaagtgctaaggtaagccttactcatagagagtgcattattttaatcctattgctttaggtgtgtttttagtcttgtaactagttaaaacattgaatcatctcctcaaacagagatatactagtcctaacaactaagatggattatcaccggaatgccaactattatacagggaaaatttaagccactgcatcttccatcttctcacttctccaatatttctcccatacagctattattccatggggaaaagatcattagtaccatgtccttaccacagaaccatcagaaggtggctaaattactaggtggcttcatttctctagctgtaaaaatgggggtgacagctacttcacagagctgttgggaagattgtgagaatgtatttataaatggtctagcataatgttggctctataataaggatttaaaacattggagaaggggttgagtgaggagggggaacagcatgaaccacagtgtgattccaacactgtagcattctcagggcagaaacagtcgagggtgaaggatccaggcagaagggtacagggaggcaactttcagatgcccacccaacccagcctggtttcagaacagggcactctgatgggagtctaggtcaagggattaattgcttaattccatactttcaatgagccatgtgcatttatttcttggatccataggtctcaatgtctggataaatgaaggcagtgagcagtgatatgggtcatccaatagggtttttaactccaaagaaaaatcattttaatgtagcttttgggagttgtcagattacttatttgtgcagcagcagcttcgtccttcttcctgtttgtacttggttccaagtggtgactggctggatccccaaaagcacatcactaaaggtaaagagaaaggaggaagagggaattctcttttgctgatcaccccctgtttaacaagctctgtgctaggaacttgacacatcttatcttgctcaatcctcctcattattattattttacaggtgaggaaaataatactcaaagaggttaaatgactttctaaggtcacctggccagtaggttagggaactagaatttgagatcagtttctttctttaaaacaaacaaagaaaaaaaccaaaggaagtaatgtatgtatggtaacaggtcaaatgatccacaggtgtataaagcaagaggtaatcatctcttcctccttccagtaacatcctgaggaaaccagtgtgaaagtgtattaggcatcattcaacatctttcagtatactcctacaaacatacatacaaatatatacacatgtatatatatatttgagaggttcttttctaaaaaagaagtatttttataaaaagtaacattatgccatggatgtccctccatgtccatactaatagagcttctctttcttgtgtaaagctacagaacttctacagtttgaatgcacttcacttttctcaatcattccctagatgaaagacattacagttatttccatcttactttaccatgaaaatcaatgctgcaataaatagcctcagagatattctttttcatactggtgctttcatttcagtagaaaagattcctaaaggtagtattgttcagtcaaggtaggcacatgctttattttaatagatgctgtcaaattagtttcaaagatactggtagtgactatgatgaacatttactctcctatcggcaatgtgtgatgcatccatttccccaaaatctccatagtattggatgttatttattatttatttttagcaatctacaggaagaaatggtatctcactgattgaatttgcattttctagctactagaaatatttctagtatattctcatatgctcattgattatttgcatttctcttctgatcgtattcttcacatatttttctctgggttatttatgtttttcatttcaacttcagctgtcatgtgaattatggagatattaaccttttgtgacatggtataaatattttcttatagcctcttatctagcttttaaaccttgtttttgatattttgctatataaggattttaccattttgtatggttggatttgttgataattttctttataaggtttctgggttttctctctcatttaagatggcctttccaactacaggttatatacgtgtttttcttacatttttataaaatatttttattgttatactttttacaacttgattatttaaaaatataccagtgattaatatttgtatatgctatgagacaggggtctaatattttttccctgataaaaagtgaataatgccagcattatttattaaacaaaccatctttcaccatcaaactgaacgcccctttgatcacagattaagtttccatatgtattggatttgcttctggtctttctagattgtttcacctatttgtgtattcttgtgtaagtgtcatactgttttgagtgtagtaacatttatggtaatttatacgacaaaacttccttcctgatcaaaaagatgctgctcttcccctgctaccactacgggaccgtaaacacccaagctccacggaaatctggagttaggactagtgatcctaggaacccttaagctgttggaccattcttgggggcacaagactgtcagaggttatctggctcctcctcatgtcttcaggtagttaggtacttcagtcatacttgatagaggacagtgtctgcccctttcctcaaaaagccctcaaggggaaatttgctcttttaatcaccttggaagtagactttattatcgccctgattctcaccagtcttaatggaatctgagacatagagacgtcaaactaacttgttcaagataaacaaaaaaaaaaaaaacaccctggcaagtggtgaggtcaaaattcaaaactcaggttgttctggctccagattccttgtgttcttataactcctgtgctatacttcctccctaacctggtgccctgacttaagccaaacatgttttcttctgagcctcagtctcctcctttgtaaaatcagggtcataagaggacacactttgctgaatatctttgtccaccaaagtgatagtgaaaaatcaaaacaataaaattagcaatgatcatcatagccaattctttttattcaccaagtcatggagtatgccattggtgggaaatcagaaagaaggtagatttacatcaaattctacataattgcagtccccaaagatgggtactagttttcccattttacagataggaaactgaggctcaaagagttgagtaatttatccaaggttattcagccagtgcacagctgagctggtgatttgaacccaggtctaaaattcccactcttattctgctctcattcatccctcagacctagcacagaattaagatgaattaagctgccattatggtttcctcctcaatattttgctttctgagaattaagcctcctgaatcaggtgactcattcttgcgagaatccacaggaaggcataaaagacagtctggttgacgtaggcattaagctcttgtgtgcctgtatcaggtttaagatttagtctaacagttgtattaagcattatcaggttacatttggctagcaatttttcttgccccatgtaattacaggtgcttcagataaaatctgaaattagttgatagaaactgggaattaaaaccacaaagagaggaatgtctcaatgcatgtcaataaaccagcccattaattatttctacctactcaactctgaagaaaacgaccaggctgatgcctctggataatcacatgacctacttgatgtttatacaaaagctgaatcttcttggctttcagaagcaaataccagtaatgttgaaaccagcagggacacaagaattaaatgccagaaaaaaataatatgaccactgaaaataggtgatcttcttcagcctttgtaaattctgaaagttcaccaaaacagtatcaggtgatgatttcccacaaattcaaacatctggtgaagcacttctaaaatcctgcaaaacatctggatatcatggaatacatatgtatgtatgtatatgtttagtatgtaaacatctcactgtccctctatccctttaacactcactctctctgtacgtacatgcaaaattatacccttacacacatggcaaaagtaggtgaataatgaagggtacagtagaattgcaaaccctaccacatattaataactgtatatggagatcagttgaacttagccttacagcccattgcagcagtggatacctcagtttttgcaatttctcattgtcttcacatttgtgtaattctatagaaacctccagctgttccagtctgtcttgaggtttatgtgtatgtagggtattttctttattatttacacaaataacagggcttagttatcttcatgagacatcaggagaaataatcttcatgctgccactgagtcttggaacccaaacacaacacaactggtcaccaaagatggaacgaaaccacatatataatccgttggtgttttaatgattttgcactaggattcattgtccaataaatgtgcaatgtattttttatcgaggtgctagattttgcttctatgatatagtgtcttgaccaacacatttcacttgtcctcttaactttcctgttagacttttgtataattacacttcctattagccaggaaggaaatcttgcaggcattatatatatatatatatctgtcatctcccaaatcttaccatgatcaaatctgggtgatagctttgaatgctttgaatattgaacctagctactagtagcctaatgcaggttcccactgccaggtgccttagtttttactacagtatcttactaaagttcccttttacaaatgacatgagagcttggcagacaaggaagaaccaggactaaaaattgggctaggtccatggtccacaacagaatttagtgcacagcaatgtaaggatgatgttactctagacctgtgttcccttgcagccctggagttctgatttgatgctaccaccatgttgccagtttccattccaatacttgacacaatgtagatactcaacaactacttattgagtgggtggatggatgcatggatggatgcatgagagagggcaggaccaagtgtctgctttgcataccattttctctcccgtccttgtcatactatgatcttacaatataatttgtagaatgagtggagaattattctacttcatttcaatacccccaataacacaatatgctcatgcttacttttgtgcttttgctttaattattctttccactttctacaccccatagtcaaattctatacctcttagcacccctaatttaaatactaatccctccattaagtcatcctttactattgaaatcatcactctggatttctagagaagctggttaggtgctagaggattcctacttaattatgcatggctatattgttcattgtcttaaaaatgcatttcctaaatagatgcaagttcttcaagatcaggaactctgatatggcacaagacctaattacagggcctgggcctataaaaggtgactgaccaaaagtaaatatctctaaagggtttttaaagaaaatctcttgtattcaaaatgactctagcaggaaaatagatttagtgaatttctggcactcctcaacaccttgtacccaaatgtatgcccagcctttcggggctcctggcagttccaccaacaagcctttgcctgcagtggctgcactgcctggagcatccttccttactttcctatgcatggagtgcttgttgcaagcatgatctgggactcaaaccagagactctgattaaataagtctatggcgggatccagagatttgcattatttaacaagcagcccagctacttcccatgcaattgtccataggtcatgataataggagaaaccagctgatgaaattaacatttattggaagaaagcaggtttttctcagctttacaaggtcagcaacatgaccttaacaatgacaggcctaaagggaaaaacacatcgactaaagggtcaataagaaagtatggaacagagaaacaaacattcaaatgttgcctcctgccctgccccttgagagagttacagaacagtatctcctggtggggttagtaaaatttcactgggacccaccattgctctcaattttctccaccttttgttctaattcttcgtccaccaaacaacctttggatagaggttaccaagtgttctaatcccaagaaagaaaaagaatgtcttagatggcagacatgaatagttctgttatagaaaggggatttcccaattcccacattttaaaatgaacggtcataatggcttattcaccatcctgtgctattttaatgatcaccagtcaggcctaaggtccaaatcagtgaatataccaggactatcctgtttctggaattaagaatatgtttatcagacatggggccatgaagttttaaccggtatgtggcctccaacaggcactgccagcaaccagaccctgcccctcaatggcctacctctgcaggctaccctcaccttatgggaagagagtctgcaacttatcatcacgtaagaaacaataagctgcatttaaaaaccaaaaatgatttgtgcacaaagacattaacaagaacataatttatcataatgaaacactgaaaacaatctaaatgtgcaacaataataggggaacggtttagtaaattaggtatactcacataaagaatattggtgccatcattaacataaattttaacaatacagcaaatttttatatatagtctcaaatatataaaacaatgtgcactggagggacaaaaaaataaccaaaatgtggatagatgttatctctggatagtgaaattacaggtgaatattaacatacatgtatattccaagctatttacaatgaggaggtagtactttcagagttaaaacatttgaaaaataagactgcttatttgggccagattttaacactacagagaattatattctgttaaactgattaattttcttatcacatctcttttcattagcaaggaaatgataaagagactctacttctctgcacccactttccgaatttctgggtcaactgggatgatccgggtagacccaggaataacatgcaggtggtacaccctccccttgtaggaaaggagagaaagggcagtcacacttagcagttgtcagaaagaagacctgggagacttctctatatcaagcaagaattcctccttttcatccctgcccttggacaagagaagctaatagggatttagttaattggctggttttcatcctaattggctgatgaatccattccaatctcaagaaaaattgcagaggaagaaacaaatgagggctcagctgccaattgatgttttagagacggcattttatgtgtcatgaggtctgaggtcctggagctcagagtattagctttccgggagactggggctccatcaagggtggggtaaatatccttgctgggagaccacaggctttcctgtctcattgaagaaaaaccgaaaacgatggcacacattcgattttgtcatctaatgctaaattcagattaaatcaacacggactcgttctggggtagggacagaaaactccagggggctgaggctcttgcattatgtgggccttctgaaggtgccaggtaagccgatgtcagctgagtttgctcctacttttcccacatcagtcagttctaccacttaacagggggattagtaatctcatttcttgggactgtcatcaaagtatcagaataaaaccacttagtagagctagccttctgcaaaatgttgaggtgggctaaattggtcttccacaccttgtcacctgccttttaagcctccttcccctcgactcccttatcaggtaggctatttccatttctcactccctttcagtctagctctcctgctccccatgcaagattacacctctcacagtcacacagtctgaactgctcattggtacttacgatcagatataaacaaaaacacacttaggaaaggtgggaatgatgatagaaatttgtgctagctaagaaattcaggccagatgagggctatgaccaaaccatcctaaaaagatcacaggaaatcttgtcatttgggacaacatggatgaacctggggggcggcttattaactaagccaggccccgaaaacaaatactgcattatctcacttacacgtggattctaaaatagttgaactcacagaagcagagaacagaatggtagttaccagggctgggacaagaggagcaattggggagatgttagtcaaaggatataaaatttcagttaagtggaataagttccagaaatctattttattaacatggtaattacagttaaaaacaatgcattgtctacttggaaagtgctaagaacagattttaagtgttttcaccacaaaaaaataagtgtgtgaggtaagacgtatgttaattaacttgatttagtttaactacttcaatctactgatcagatgcttgtagtatctctggggattaagaacactcaatggctcctcattgccactggtgcactgaacctcctttagtctggctttgactgccctttgctgtctggcagcaatccatcccgtgggacctgttttctgtggctcctcatcttggcctctggctggatgagagtctgacatttccagtgtgtcctggtgctttcctttctccatcacaccatgtccctcacctggcatgcctactcattcaaatcttactcattttccaaggctggactcaagtattgcttcctttgaggattttcctcaatgctccttacattaagtgatactttcttcttcctctaaaattctgttttatccaatgtctctgccatttgtaacatgtcttataacaatagcagaaagcatgtttttgcgtcttaataatccttgtagcttatagtatgataatgaaatatacgttgtttgatgaatgaatgaggagtgaatttttaaggtatcctgggcataaattctgagtgaatgctaccacaccacacagctggacctttctcttattcttgtttacttgctctggctctcatatattcgcacatttctgtcagcacaattagggtatctaaattgaaaaataaaatattgataagcagagagaaaaacagtaaaaacaaaaatatgatgaatgcttccattgtctcagaaatgacagacctttttctacttggcctttataatgtaattatttaagtatttctgtatgtagaatccaccttgctctttagaggccctcaggcactttttacaatgcaacatcttgattttggaatgcatcttcatgtgcaaaaaaaaaaaaaaaaaaaaaaagccaaaaaccttgtctagactttgagtcacctttatttgtgtactgtaaaagaccggtaggagcagcccaaatggctacagtgaatgggagagcctcataaaatccgacaaaggttcacatacctgaggtttgtaaacacagcatatgttcttgtcagtgtagatgtgaccttgccggtctctttgcagactatattagtgctgtgcaaatatttctactcaattgtaaaggcacattatactcagggaaattattctcccagcaaacagacagatgtttagcttcactttaatatgacactataatctgaattcttaatgtgagacagaggtcctgttggagctagggtgaaactacacatgcaaagttttaacaatgcagcactttgtagcatagattaagtcactacctctttctgactaaaactttctgctctttctttcaagcccctcttgtagcaccatgtgcaggggccatggtgcacttagcacaccttgacaatcctgagatgatgcaggaggtggctgtgaggatatttatcagtctctctgagcactatcaaacacttctgcttgcaaagccctatagaataacatggagcaacatatgtccagttgtgaggttcccctcttaggagaatatgaaacatgcctatcctagagatatcagcaaggctcaaaaaattcaaggaaaaagaaaaagtagctggggatagaccaaacccacatatctagattcattcttgggggctttggcattcaacaaacagatccatcttcaacttgctagttgttgtcaaggttaattatcctttaggacttcaagtaaaggaggccaaggaaactgagctcaactcaagtttagacacagtgaaatttcttttactgctgggactcagcaacaagactgccacccctgtgaggttctctccattttcaatccacttttctacactccgcctgtattgctggggcaggggctcaataagccatatttctgctttgtcagctcattcctgcaggctctgcccataggaaatctagagagacactggaaggctggagctcttcctgtttgcctcctgttccggttggcattattccagcgatgggtcattgccctggcacttggttccactcttcagatttaccctcccatattcctagaacaagactcatcataaccccttggacacaccaacaccaaccagctgcaacgctccccagaggactgggttccagttctgcaagggcctcctccaagctccagagtcctcaacagcaggtggagaaagccctgctatgagtctccagttctgtgctctccgatgctcagcttctaaattcttttcccagtcccttctccttattctgccgtccctgaagtggtagttggttccttttattatgacttttttgtggtgcaccagggtcttttatgtgtgtgcctttccagccctctaatatccaattaaacaattattttatatgaaattatcacagttgagataattgcatggtttctattttcttcactgggccctaattgacataacttattacttgtaacagagttacacagatgtttgctaaattgctgatattatatatttttgaaggtatatttacatgctaaaaatgtatgattaatctgcatctattaaaaagaacatgatagatcactattactgtccagaaagatgtccataatatattgagtgataacagcagtgattttttattagtaagcatttgtttcatatataagaaaaataaataaaattatgaagaagttaaaaataacggatactatgatctctatgagaatactttgttattcctatttaaataactttgagaatatctttagcataagtaattggggcagcaggatttttcttctgcccaatatttagttgggattgcaataactatcaaacaattaagatgcaatttatgtctttgtcacaatttgaaacccaaaacatttatataatatgtgtaattcaaaggcacacatgctactgcatctaaaatttaactttttaactaaatataactaaaaccaactcacagaaaagtctacagctgggaagaagaattagtaaaaactttaattgtggtctcatttacacttctattttcaaactcattcatgaattaattttaactctgtgcctctgccttcaatcaagccataagtacctgtcagaaaatgacagtgtttgaatatctgcacatatgttggaaatttctacactttgattcctttgtcaaaatttccacttagagctgtgtgggtgaggctctaaggcacaggcaaggaggttagtctctcactgtggccaagattccacgccaaagaatgttcatttagcgtgtaagccaacgcagaactccttattaagacagttggccctcagagtcttataaagcaggaggggagtatgatgtatggaagcaaatgttgagcaggaactacagaaggttagccttaagggtgatgttccatagaggaaccttgggctaatcttaatctgtgaagatggacattggactatagagctttgtggcccctgtgcagcctgccattatacaagatcacttaactacaatgtcttaaagcaactcagtctaaggcagtagttgcaaaaattttggatagtatatccctgttggggaaaaaaatttgcgtgcaatgccaccatgtgaatatttattcataaattacatatggatgctgttatactaattattagtacaattaggaacaattagtattgggtaccctccaagacactgaatatcagccagcaccctctcattcagttgtagtcacactgaccttcttactgatcattagccttgctaaacatgccctgtctcaccatccctgcactggatgcctctctgtccactagccacttggttcatattctcacctacttcagggctgctcaaaggtcaatctcagaagggcttctctgacttcctgtgttacctctgaccctctgtctcctctttactctagaacacttgtgctgggttcctctgtttaccttgcagacactgctttccccttctctgtccttttctgtgccctgggaggctgatttgcatggattacattcaactgggctcccctgaattatggcttctctttgggtttggccaataggaggcactcgcagggaactggagggtgagaagagagatgcctggacgtttattccatcagcaaccacccttgcagggctatggatgggaaatggctgttttcctctcccaaggtcacacctcctattgggtgtccttctcctaccaccaatcactgcttcctcttcatttgggccaccgcttcttgccctggaggagatagttccctattattagaaggccctagacgacttcaccattccttgttagtttctcttaaactctgcctagctttctataaatagcttttcgtgcactctcctcagacatttactttgagcatgccatctgtttcttcccaagaccctgaatgatacagcacttatcaccaataaatatagcatatatttatattgatagtctgattcctcccatttgaatggaaaatagccgagcgcagagatttttcacctgttgttgttttctgctatgtgcttagctcctaggatagtgcacagcatttagtaggcacccaggtacctgccaaatacatagatgaataatattttcctcctaggtcccaatggattgtcttgcacattccattttggaaatcaccaacttaaggaacaaatatatattattcttcaccaggttttactaagtgttggactaacctagcttaattcctacataatacatatccctgattattttcaaagcacatgaaatgtaatgtagcaggaaactctcctgaaagttctcaggttcctcctccaagattctcataatgaaagctccaacagatattgagccaatcatgagaaggaccttattagttcaccttttcaagttgtctttaacagattttctttctccctcctgatttccgttttaagaacatttcttcttttctttcaataaggaccataaaaactgcccaaggaagcaaagccttggctcactcactttgtccctacttgcaacaggagaaaaatcatcaaaatcctgttccccggctcagttacttaatttgcatatgatgctccattacttaattatcttataactcttagggcttagttgcccaaatcagacttaacaatcatctttggtaacaacatcccttacagcaaagagctaactcaaaagaaaatgattttttaaaaaaatgacaaacacatacaaatacctttttgtcctccatgcaaaaatttgggtgatggattctttatgaattgctctatgcctattaaacatgcccattactttactattggaaaaaccagattatttttcacatgcctgagtttcctttctttgtactaatcaataactgcagatgtactctaagagttgctaccatactgaacaaaatctgatcttcaagacaacctcgtggaacctgctgaggttgccttgggagggagaacctaagtggtgagaaactgctgaatcctgtatccaggaggaaacattctgtacacacaataacttctatgtgcatgtggctacaatttttaatgctgtgctcatctctggctatatatagtggcatgagtaagagttttctcgtgtggttttgagtttcttgagctgtaaatcaaaacattgtgatgttcaaacagtctttgggaagaagagaaaattaactgccaaaattattaaaatggaactctactttctattagaaccagaatagaacagcttgcatgaataggtaagtgcaaagtaagatataattttctttcacttgaatggcgtttgtatttccctctgccagcagtggtatgactctccaatgttgtattactttgctaaagctgctataacaagtatcacacactgggtggtgaaacaacagaactttactgtctcacagttctggagagagttctcatttaacttgaataattatatttgcaacaaccctttttccaagtgaggttatattctgaggtaccgggggttaggactgcaacttgtacatttgggaaaggggatgtaactgcacactggctcatgctcagctatttgagaggctgaggtgggaagatcacttgagcccaggagttcaagcgttcaaggctgcaataagccagtatcatgccactgcattccagcctgggtgacagagagggaccctgtctcaaaaaaaaaaaattaaaactaaaagaagatcaataaatttgggggagcacaatttaaccacaacaaatggtaaaaataaaaaatgttaggtcttaagaaaatactaagaaacacttggtccagctcttttgttttttagtgataaatagaaagggaaaatgtcttatccagggttacctgtcagcaatagcaacatagactcagagcacgaggcacaaggctctgctctggtgctttccaaagcacacactgcctttatttcattcttcccaaagctgagactcacatgcatttgtggaggggaagtagcagcagtgactcatcctatatgaaaacccatccagagacttatgtgacatatctacagcaacttgctttgtggaggtcattcaaaataggagaattaaaaaaggactaggctggtcttgaactcctggcctcaagagatactcctgcctcagtctcctaaagtattagaattataggtgtgagtcactgcatgcagcctagattcaaagtcttatacaaactttcctcgtttaaatcactgtgtggtttgtctcctgattggactcagactgatgcagtctgttctagtaccagtttgtttttacattgaaatatttgctccatcaggagtttatcttggtataagctgtgagtatggatctagctttatttttcacagatggctatctggttgatccaaacatttattgaaaaacttttttcctaactcattttaaataccatctttattatatactcaattcccacatgtatttgggtttattccagactttaaattgtattccattacactctgtcttttccatctccactaccacattgtttgaatatctgtttaatatctgataggaatagtccctggatatttttgttttttttttttaatttgaactttgttatcagaatgtctagatttcctgctggaaattttattgggaattgcaatacgtttgtagattagggatatttgacatctgagtcttctcaagaactagccactttttattagttcaagtctcttttggtgtttctcaacagtattaaacattttttaattcacaaaaggagcactgtgtatatttatagtgtacaatatatttgatataaatataccaatagcattttaattcatataaatcttgcatattattacttttattcctaaatatttgatcattttggttattgtgatggcatcttttcttccattataactttttaacttgttgctcttagatatataaagggtacaaatatcaaacataaaaagggaaagcaaggtttcaaaactgaattacaaaacttcagtgccagacactgtacctggcaattgctcagtgctccaagaaagttaaaccaacaaataaaaccaattttaatagtgataagtattactctgttgtgattagagcttccaccataaagtattttcaagtccattatcatttgttttctgcaaactctgagagacaaacattattctcatttgacagaaaggaaaactgaggttcaaagataaatgactttttaaactaaagtgttacaatttgacagaaaggaaaactgaggttcaaagataagtgactttttaaactaaagtgttacaagccagtttgacaaagcttgtatgctattataatttcagattcaaattccaatgctccctctcctaaatttttattgttttgaggaaaattaaactaaacattaaaaaagttcatttacttccatttttatgcctcccttgaaatgcaaatttagcacaagccaaccatctctctctaagcatttccaagcacttgaggcatccacttctttgcactcagcagatggtcataaaatatgaacaaatgaagacagttcatctttagactctagggagtcacggagtcacataagcttaggatttgaatgggcttagaggatttctaaataatgctctctggtttataaataaaaaagctaaggcactacgtcctagagctagtaaaaaaaaccagatatcctcactcccaaaccagtgttctgatgcttgtaaaatctggcactggtttaatcagagagtgaccagctggaataaagtcctgatcagattgcttttattctgctttctctgaagccaagaaaggtcatcaaagatgcacaggagagactgcaaatgagtacaatactgtgcaacagtgatattcagaattattaaattggaagccctggtgccctttgcaggcacaaagcagctcctctgtaaggaaatgaaaagaggttgcgtgtcgagggatgaggcttctttctatagagaccccattacagctccagaggaaagaacatcagttccttccagggagtctgtgtaacagataatgtatgcttcttttcaggctgtcaagattcacaaaagagataggaagtttgaggctctattactggtgaccttcccacagaatacactgcatctcatttttaaaaatagcccggctcttgggtggagtatttgatggccttcataaaggaactgaaaactttgggagaagtactgaaaggaatagagtgaaaaagagaaagaagaaagcaagaggcaaaaaagaagagaaaaactggtttcctactgctccttcatctttctgcatctcgaagtggtcacctttttttatctcagagcctcattacctctgagaggtttcctgatggcctcaactcatctctaccatccttcagaatgctaaacaggttggactttgtcaccacccatagaaaccttggttatttccacattgtaaagtccgcattccttagcatagcaagccaggtgctttttggaaattcagcttccactccagcttcattttctgctccacttctccaggtaactcatgctttggccaccgtggcaacttgccactcctcaaacatgccactggctgcccactctcttgggcatgcttttacttttttcccctttctttcatcaatcaatattctccctaagaatcaagactcagatcagaggctcctgtttctgagaaaccttccagccaaaatgaatcactcccccacctaagctttttctctggtctcaaagccttctactctaagctctggttcttttgattagacctaaagacaaagccatttgtaaaccaataacagatctgataactttttggttctcacttataagtgggagttgaacaatgagaacacatggacagagggaggggaacctcacacaccggggcctatcagggggtagggggaaaggggagggagagcattaggacaaatacctaatgcatgcggggcttaaaacctagatgacggattgacggatgcagcaaaccaccatggcacgtgtatacctatgtaacaaacctgcacattctgcacatgtgtcccagaacttaaaataacaaaaaatctggactaattttagatttccaaaaatgttgcagagatagtatagacagttccccacctaataatttttagaagaaatattttatagaaaagcataaagaatgatattaaaaacacatgtatactcattttccatctttatcaaatctcaacattctgccatttgattcagatttttttttaaagatataaaacaatacttggttctccatgtaagtctccttgattctaaggagacttgattctaattcttcctactcagaattaagcactctcctgatttggcatttatggttaattggcctgcttttatatattcactacacatgtatgtatcccagaagttatatttgattgccttgtatgttgttgtacacatatgacctcattctatatatagatcagctgtacatattttgattttcactcaacaatacatttgtgatttttgcagatgtagttcacttattgaatgttctatatagtattttattgtgtggatacacaaaaataattgtcttcaacagatagaaattttagcttctcatttgttttttaatgtagagtaagagaaacatacaacagtgcacattgcagcactgcttgtattagcaaaaacaggaagtggatctggattgatccattaactatgaatcttacccatccttaaacatcatttaagcccttagggtagaaaagaaattatggggaaatcaaaatgatacatttggcagtggtgagaggcttcctgttccttttggttcagcaaaaaactttttattctttagacctacaaaaaagcagaggctttttttttgacccacacccaaagcagagggaaatcagtcagcatttttaagggaactacacatgctacaggggccctttagcgtctgccaagctcttcccagtctcaagaatggaggtaggagatgctgttcatgctattatacagaatggcagaattaagtccaaatggcacctggagtcttacctctttatatcctagttttctgtattcagtactggcccagattgcttttattttctgttgaaataataaactcttttacaaaaaatatgattgtttttcctcagttttaaaatatgcctataaatattctacaggaatagagggtaatagatgagctcaagtattttgcgagttaattaaagtagaacttggatttatttcgtaacgattttatacaaattgaaaggaaagtaagaaacgttattccaaggtgttcaaggcaggccttgtaccatctcacttcccactggttctactgaaacatttacatttatcactttttttccttctgtttattatgagagtatctaatttcataggcatggtggtagaacattggggtgaataagatgatgtctgctcttaagaagttacttgctactccctgaatatatgaaaactttttttttttttgtaaagagagagtgatggtatggttcactaaggaaggcaggagattgagtagttctggagagtcacataggaagcatgttccacatagagggtggatgcaagtgaaggccaagttgtaaccatctatcactgcctccaaggagcacctgcaatagcacatctacttggagtccaagtcctggttttcatagtttggccaattccatcactgcccaaaccatgaagtaagaaaaataatacaacttagttcaagagaataaaaacaaaatggagtgtgccacacaccagctatattcaactattttctgctctcctagagtgccatgcatttgcaagcctccaagcctttgcagatactcctgctttgaatgacattccctgtattctgtacttatccactgtgtaatgcaaccttaaagctaattttaagcattgtctttctaggaaacctttctcactccccccgagaggggtgaatcatccctcccttgtgtatattcccagagaaggctgtttctgcctctgtaaaatacagcactcagcacagtctgacaaatagtctcgtaaattgtgcatgcctctgtgtcctttactcttagaaggcagggactcatctaattcatctttgtcgtgccttcaatctgtggcacagtgctaacatatagtaagtgttcaatgtgaagttcattaaatgacgtatgtagctgcaaagaaaaaaacacgtagcattaggaattagagtagtcaacagatagtggtagtagaattgcctcaaattccatgtaagtatgattctactgaaaataactgagttttttttttttttttgataattggcattaattcccttggctctaccaagagatcttaggttcaattccctgggcaagcaagcaaattgtgtatgtttgagtgggtaagtgaggctattccacatgaatctcatttagaaattatgttcaaagcaggccatttgctactggattcattacctttcctagatagcacagggtgaaatgtttgcttttattaaagtaaataaatagctcataattgtgcctaggaagggaaacttaaaggcaagaagaaaaacactagacagggaatataaaagtgtattattttttcctcaatattgcggttcattatatttttgaaacagttgtgaatggcttttccttaagtaatatctgggctcttttctctagataatttacaggaaaagagaaatataccttagcaaggcaggctaaggaaaattattttaaaactcaaacatatcaggctaaaatattcatgatgtaaaaacaaagcaaacaaaacaaacagataagcaaaaacaaaacgagaagaaaacatgagaataccaatagaagaaaaatatgtaatttggtttggttccagctctggctgtgattaagcatataccatcctccattttccattgattacaaataaataaatataaggagtctatctgaaaattcagaaaagtaaataatgacaggtgaattggggaatgaaatgaaatggaaagtagtatcaatatggtattaagcttaaaggtattttcagttttcttcttaatcctccagcttggactctaggacagcccaaatcccagaactgcacatcaagcagagacaggaaatgcttcaagggaaacatatgtacctgtctgtattctagaaaagccccagtcacaaagccttagactagtgaaagcagcagctatgcatacacctcaaactctggaagacattctttttttttttttttttgagcagagaaactggaaaactaggttcctattgttctctctctcgctctctctctctgtgtgtgtgtgtgtgtgtgtgtgtgtgtgtgtgtgtgtgtgtgaatcgtcattaattttctctttccagtctctctctggttgttttgccctcaagggaagcaagtcatcatgggaagtgtgaaatagcatagggaacctaaagccctgccatttatgacagaagaccagagaaataagcccctggggactagagagtgaagagaaatcatggaggagaaagtggtagagaaaaagtacacctaattttgtgtatgaagtctcaggctcaccactaattggcgcatgcattgaaattaaccaaggcagcgtaacaactgctttgataattaaactatgatatagaacaaagctcaggttgacccctgggtggttggtatgtgtgtgtggagcagacaaactagctctacaaaggaattgaaaactaaactaacacagaagccagagtctaaatagagcaggttgaggttagacttatgacaagaaccatgggagactgattacctgctaagatgaaaaaaaaaaaaaaaaggaaagaaaagaaaagaaaaatcttctctagaggattttaacaggaccagagtctaatatataatactcaaatgaccataaggcaatcccaaattactaaaaataaaaaagagcatctcaaaagtcaatcaactgacatcaatccccaaggtgacccatgatgttgaaattattggacaaagattttaaaggagttattgtaactatcctctatgaaaagaaaaaaattcttttaaaatggatggaaagaaatgttgtaaaaaatagaaaatataaacacgaagtaaatattttaaaaataaaaaataactaaaaaataaactggatgaatgcaatagcagaatggagatgccagaaaaaaaagaagagtcattgaatttgaaaagtagatcaacagaaataatcctttataaataagagagaaaacacaaataaaaaaatatgagcagagcctcagggacctgtgggacatgtcttacatttgtgttactagaatcccagagggggcaggtaagagattggtgcagaaaaaaatagctaaaaacttctcaaatctgtggaaagccataaatttacagatttgggaggctgagaaacaccccccaccaccaaaaaaaaaatttcatgcaaattctcatacttaaaacactaaaatccaaagataaagaaaaaatattgaaaacaacaagtaaaacaaacactttacatatagaaaaaaataattcaaatgacaacgtattttagtgaaaatcatagaagccagaaagcagtattataatctatttgaagtattgacagtgaaccattaattctaaattctatattaaccaaaaacattcttcagaaaaaagtgaaataaagaccatctgatcatagcaaaattaaactagaaatcaaaaacagatatttaaaaacctctaaatattggaaaattaaataactcactttcaaataatcaaaatatgagagaggaagtcaaaagaaacattagaacatattctgaactaagtgaaaatgaaaataccacaagtgatggtcagttctgtattttcaacttggctaagaggtagtccttgttatttaatcaaacatgagtctaggtattcctgtgaggtattttgtagacatgattactgtataattattttgctttaagcaagaagattctgagttgaaaggcgttaagagcagaactgaggcttccctgaagcagaagaagacattctaactatagattgcagcttcagctccaacttatgcccaagagttccagtttctaatggcttgccctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttagagaaaaaagttgtacattaaatactgaaaagttacagcactaaatactgaattataagtgaaaaattcaaatcaataacctaggtttccatattaaaatattagaaaacaaaaaccaaattaagccaaaaccaagcaaagaaaaagagaaatgtcaaaggcaaaagaaaaaaaataaatgaaatttaaaatagaaaacaacagatagagtcaatgaaatcaaaaggtggtttgttgaaaaggtcaataaaatttgataaacttctaagaagactgaccaaagagagaagtagcaaattactattagacatgaaagaagacataatactacagacctcacaggcattaaaatgatattaagagaaaattatagacaactctattcccccacatttgacaactcagattaaatgaatcattttattgaaagataaaaactaccaaaactgacaagaaatgggaggtagtggtcacctggatcagcagtctgaggcactcaacccttactgtgcgtagattctggtgcagcgatgccctctctgctccgtgcccaagcagatctccgggcattcaaagcaccggctcacccggattgacagcctgagctgcctcacctttcctgcacagaaatcatggtgcatccaggccctctccacttcatgcccaagcagatctccaggcagtcaaagcaccaagtcacctcgatcagcagactgagccacccaactcctcctgtgcagagactgtggtgaagcagggccctctctgcccaatgcccaggcatatctccaggcagtcagagcacaacatatttgcatggattataagcctgaactgccccaccctttctgtgcagaaattgtggtgcagtggggccctctacactctatgatgaggcagataaccaggcatctggagcacacactttcctgaatcaggagtttaggctgaccttgccacttgtgcagagaacttcaggcaaaaaaggtttcccagccccttgcccagtcacacctttgggggcttggtggcccttcactcatttcttccttggtgctgatgcatgtggctgacactgggggacctgtacatgggcctgcccggtctgacctcacccatctgggtccccaaacccctcaggactgaggagacagctcagacaactgtgggctccatggatgagcccattgctagaggtagaagctagagcttctactggtaaacaagaataaaatatatacccaggcatgttggccacaaccagctcttacccataagtaccatctactggcttgtaagtcaaaccacagaactcaatataaatttaccaagaggaagtgcatatggctatagaagcaaaacaaaaaaccatattcaacattctctatggtcacaccccacagggagtggggggaaagagaaagggaaagaaaaaacccgctaatgatattatagggaaataaagaaaaaagggaaaaatcctacacacagttaaataattataaaaattagaagtcctattatctctggatgagaaaaaaatggtgcaaaaattctggcaccatgaaaaatctgaatgtagtgatgccaccaaaggatcacagtagttctccagcaatggtctccaaccagaatggaaattcagaaatgacaaagaatccaaagcatgtattgagaggaagctcaatgatatctaaaacaaggttaaaagtcaacacaaataaactcctaaataaatcaatgaaatgaagaaagagacaaacatcttaaaaagaaatcaatcagagcttctagaattgaaaaactcaaggaattgcaaaatataattgaaagctttaacaatagactggactagaaagaagaaataatttcaaagcttgaagactagtcttttgaactaacccagtcagacaaaaattaagaaaaaaaatttagaaaaatgaacaaagtctttgagaaatatgagattgtgtaaagtgaacaaaccaacaaattattggcattcctgagagagaaggagaaaacataagcaaccttggaaacatatttgaggggctaattcaagaaaacgtccctaatcttgctagagaggtagacatctagatacaagaaatccagagaacacttgcagtatcccatgcaaaatgaacatcaccaaagcagttacccaccagactgtccaagatcaacactaagaaaaaaatctcagaggtagctagagaaaaagatcagatcatgtacaaaaggaaccacctaaggctaacagtggacttctcagcacaaacctgacaagtcaggagaggctggggtctatttttagcacttttaaagaaaagaaattccaaccaagaattcacaacttgtgaaattaagctttctaagtgaaggagaaataaaatattttaaagacaaacaagtgctgaaggaatttgttactattagaaccggcttacaagagacccttaagggaattataaacatggagacaaattaatgacacctgctaccataaaaatacacctaagtgcatatctcacaggccctataaagcaaccaaacaatagaaactataaagcaaccagcaaacaacttcacaataggataaaaatcttgcatatcaatattaaccttcaatgtaaatagtctaaacaccccacttaaaaggcatagagttgctagttggataaaaaacaagactcatccatctgtggtcttcaagagacccatctcaaacataaacacactcataggttaaagtaaagggctggagaaggttctataacacaaatagaaaacaaaaaagagcagtggtcagtattcttaaattgcgtaaaacagactttaaaccaccaacattaaaaaaaggaaaaagaggggcatcaaataatgaaaaaaggttcaattcaacaagaagcctttactatcctaaatatatatgcatccaacattggagcacacagatacataaaacaacttctagaactgtagaaaaaacttacacagccacacaataatcatcagggacttcagtaccccaatgacagcattagatggatcatcaacgcagaaaactaaaagaaattctgaacttagacattttgaccagttggacctaatggacatctatataacactccacacagaaaccacagaatatacattcttctcaactgcacatggaacatacaacaagattgaccacattcttggccataaagcaagtctcaataatttaaaaaaaaattgaaattacaccaaccatactctcagaccacaatggaataaaaatagaaatccacaccaagaaaatcccctgcccccaacagcacaattacatggaaatataacaacttgcttctgaatgtcttttgggtaaaaaacaaatttaatgccaaagtcaaaaaaaaaatctttgaaataaaagactccatataccaaagtctctgtgatgcagcaaaaacagtgctaaaaggaaagtttaaagcactaaatccctacctcaaaaacttagatctcaaattagtgatctatcattgtacctagagaaacctgaaaaacaagaacaaactgaccccaaagctagcaatagaagagaaataactaaaacaagaccagaactgaaagaaattgagacccccccaaatccatacaaagggtcaacaaaaggttcattgtttgaaaggataaacaatttcaatagaccactacttagattaaaaaataaacagaagaggtccagataagcacaatcagaaacaacaaaagtgacattataaccaataccatggaaatgaaaaagatcctcagagagtataatgaacacctctttgcctgcaaactagaaaacctagaggaaatggataaattcctggaaatgaacaacctcccatgactgaatcaggaagaaattgaaaccctgaacaaatcaataatgagttctgaaattgaatcagtcacataaaaaagccccaaaccagagagattcacagctaaattctacccgacaaagaaaagctagtatcaattttactgaaactatttcaagaaatcaaggaggaaggactcttccctgactcattctatgaaaccagcatcagcctaatactaaaacctggtaaagacaattaaaaaaaacctgcaggccatagacacaaaaatccttaacaaaatactagcaaatcgaatccagcagcacatcaaaaagttaattcaccatgatcaagtaggcttcatttctgagatgcaaggttggttcaacatacacaaatcaatacatgtaattcaccacataaacataattaaacccaaaaatcatacaattatctcaatagatgcataaaaagccttttataaaattcagcatctcttcataataaaagccctcaagagactaagcatcaaaggaacatactccaaaataattagagccatctatcacaaacccacagccaacataataccaaacaggcaaaagctgaaagcatttgaaaatgtttcttagaactgggataaaacaaggatgcccattctcaccactcctatttaacatagtactaaaagtcctagccagaacaatcaggcaagagaaaaaaataaaaagcatccaaataggaagaaaggaagtaaaactctttgtccacactgctgataatgattctatacctataaaaccctaaagactctgtcaaaaggctcctggaactgacaaacaacttcagtaaagtttcatgttataaagtcaacatacaaaaatcagtaccatttctatagaccagtaacattcaagctgagagccaaatcaagaatgtaatctaatttgcaatagccatacaaaaaacacctaaaaatatatctaaccaaggaggtgagagatctctacaacaagaacttcaaaacactgctcaatgaaatcacagatgacacagacggaagaacattccatactcacaaattggaaggatcaatatttttaaaatggccatgctgcccagtgcaatctacagattcaattttattcctattatactaccaatgttatttttcacagaaccagaaaaaacaattctaaaatttatatgaaactcaaaaagagcccaagtagccaaagcaattctatgcaaaaagcagcagccagaggtatcacattacctgacttcaagctatactacaagcctacagtaaccaaaacagcatggtactggtacaaaaacagacatattgatcaatagaatagaatagagacccagatataagccacacacctatgaacatctaattttcaataaagtcaagaaaaataagcaatgggaaaggactccctattcaataaatagtcctgggatagctggttagctgtatgcagaagaatgaagctggacccctacctttcaccatatatgaaccttaattcagaatgaattaaagatttaaaagtaagacctccacctataagaatcccagaaggaaacctaggaaataccattctggacagaaataaattctgccttgggacagaatttatgaataagtccttaaaagcaactgcaacaaaaacaaaaattggcaagcaggacctaattaaataaaagagcttctgtacagcgaaagaaactatcaacagaccacacctacagaatgggagaaaatattcagaaactacacatctgacgaaggtctaatatctagaatctctaagaaacttaaacaactcaacaagccaaaaccaaccccattaaaaagcaggcaaaagacatgaacagccacttctcaaaagaagacaacaaacatatgaaaaaattctcagcgtcactaatcatcagagaaattcaaatcaaaaccacagagataccatctgatgtgtcagaatggctactattaaaaagccaaaaaacaatagatactggtgaagctacagagaaaagagaacatttatacactgttgatagaaatgtaaatttgtttagccactgtgaaagcagtttggaaacttcttgaagaatcttagaactacaattcagtcaacaattccattactggagatatatatatatatatatgaatataaataattctaccaaaaagacacatgcacttgtatgttcattgtagcactattcacaacagcaaagacgtgaaatcaacctaagtgtccctcaatggtggactggataaagaaaatgtggtacatctatactatggaatactatgcagctataaaaatgactgatatcatgtcctctgcagtaacatagatgcacctggaggccattatcctgagcaaattaattcagaaacagcaatctaaatactgcatagtctcacttataagtggggcctaaacattgggtatttattgacataaagatgggaacaatagaaatgggggactactacaggggaaagtgagagaaggggacaaagagttgaaaaactgtcaggtcctaccttggtgacagaatcatttacattctgaacatcagcatcacgaagtatacccatgtaatgaaactgtacatgtatccctgaatctaaaataaaagttgaaattataaaaaaaaagaaaataaggagatagaatacgaaaaatggcctcccaatattttccagcttaatgcctggaactgtgggtatgatgagatatcattcctgtgtgttaccctatattgaaaagggagattattgaggtataagtaatctaatcacatgatccatttaaaagcctagtgttgtctccagttgagaacagagaggaaagtcagagacatcccaagtgtggtgaggatacggagcaagagaaactctaacattgctggagggaacataagatagtacagcaactctagtaaacagtttgataatttgttataaagttaaacatacatctttataacccacctaggccacagcacagcagtaccctacagaaatgaacactatgttaaatcaaaacctgtatgcagatatttatagcagcattcttcattatcaccccaaactagaaataccctaaatgtccttcaactggtgagtggataaagaaacagtggttttgttgctgagaagtattccatgttatagatgaaatactactcagtaataaaaaggaatcaattgctgatacatgtaacaccatgaatgaatctcaaatacattgcactgagcaaaaacaaaacaaaaacaaaacagattcaaaggttgactattgtatatttccatttatacgactttctaaagaaacagacactatagagacagacaggtagtggccaaaggttaggaaatggggattaatattgaccacagaggggtaatactaggggatcttgaggggtgagtgaactgttctgtatcctgattctggtagtggttatgtgactcagaactatacaccacaaaagagtgaattttattgtacataaataaaaaataaaaacagtgaactgctttgattagcttctacattgtaatctaagattttaaactcaaatttgtatttatgtggcaatgaagggcatgatgatactcaccaagtagttttaggaaaaaatgatttactcagtttaaatatttaccttgaaaacaaacctataaggtgaacacaatctcatttttaaccgcattaaatattagttttcttttgtttttaacttgaactacattgaatatcttttttctaagctgccttcgtctaatagacattgctcaggtcttaaagaatcatcaaagcatggatttttttctctccaccgagctttgataagaaagaaaacaaaagcccacatatatttggataaagtgcagcaatctgttccaaatatcatgtaaaatgtcttcaaaacctaaataagcatgctttttgagcttcatctcctgcctagttctccactcaacactcccaccacgatgaactaattaacaacagtaatatggttattacaaattatttaccatcttctctgtgacagacactttgctagatgctttacatatgccaccacattccaggtaaaataatggttcctattttacagacgagaaaacacactcatctaggttaaacacttgcccaagttcacgtatctggtaagtggacagagctgtaatttcactgtgcgtctgagtccagatggctatgccctttctattactactacaccacactgatagttttcttattttcccttaatagtttttcaaatgtgatgccttttttcaccttatttctagcaaaccgactgacagtcttagaggagaacagtgtcccctctagaacgtcttccctaatctgctatgttgaatagaagaatagattggaaccgtaagaaacagcccagttcttatttcaactcagctacatattcatatttccacacagatggatatttattgagtaccccctgtgtgcgagggattgtgttaagcaatggagattagatcaaaaattttataaaagaaataaaccataagaaacttttgtggggatcttatgagtaggaaataagcagaaaagtccactccaggcagaggcaaacagtactaacaaagaaacggaaaaaaaataaaataaaaattatgctctgagaaactaccctttctgccccttaaatgctctttgcttctcttcacagctgtctgacagtgggaattggatgctctaactgcagtgaaatgaccaaggcgtatggagttactgagtgagctgtttgtagagtaatataagctcaaagaatagctagctcaaggagtggaaaggggaaagatggaacgcacacctcaggccaatgtagatttttactccaaatagaattttcatagcctctttaattaaaaagatactatgcaaggctgggcaaaacttgtccaattctgagctacccaagctaagtctttacttcatttaaatcctattaaagcacaatcttctcaaatatccttttatgacatctagaaagtcttattcttcaatttaattttatgagagtgtggattaaaaatatatatgaaaaacaaaaggaattatccaaaaaggcatttccttcaggaaagaaaaaaaaagtcctccacaaagtaaaaggaatattttagttttattatttttttgttcctcttacacatgaggaataaaaagagaatggaaagtctaaaaatcggaattaaaagctactactgcagcgtattttaaattttattctatatagctttcagagaggaaaagcgattctgttattaccctgcataatttttttatagcagagcatagatgtgttgctaatccaatgctaaaatgactatttggcttattcagaattatttgaaccattaactcgcatgagataagcatgatatgcattaatccttttgtgatctaattcatcagtctttccaagttactaaagctattcttcacagattctttattcttctatcctgaaaatattgtgttttgtttattctgcttatcacaaatcacagagaagtttcatttgctttcttactatttccttttaaaaataaagtcacatttatattgtcaggtaaaatacctacacagaggaaccaagaagaatcggcaataataagtggttttgagactggaaagagaagcagtagagaaagtggacaagcagtgatgaaaatttacttgactacacaatggatttgcatgggaaatattgccctgaccattccatatttgggtaggtactatttggtaattggtgttcattcattagtgggtatgatctaaatatggatttcaaaatacactatgaaagaaattccagatcagacttttgacttgaatggaatatttccataagctaaagatctacagctgttcattaatttcagaccaacatttttggaaagtctcaaaccactccatatttccatgaggagtgcctagaaatgaacctagaataaaacatgctcatttttacaggcacctccgagcttacagtttcttatctgtaaagggcaacattatgcttactatcttcataggattaagagcagaaaaatcatatggaacttctacccagaaatttctttcataagaagcacaaaatacttagtgagattttgtttaagtctgtccttgggcatgataaatcaaaactacatctgtgtatgagacatggatcctgtattataaaggaaatcttcagaaagtctaggcttttcttgttgaaggataaagcttagttaacattatttggggatgatctagctagagagcaaccactatagaaaattattacttgcttaatcaggacttgtgctatttcagataacattaatgtaggagtgaaagttaatcttatttactgattttttattagtaggcaaaccagaattttaacaagatattggaaatgtttaaaaatattaatgcatttttgagctttccatttctaccattttaaaaagaacttgtgttttatagtgtcctgtgttaataaaaagctattcttacttatacataaaataaagatgctagagatctattttattagcctaagctagtataacgtatatttaaaataattttaaatatttttcttagaaattataaaagttaaaattgaaaatttaattgatttcttcccaatttataataattattcctgtattctaccaaccaacatttatttagtttctattgatttatcagagtagtcatttgatcacactagagtgggattaaaaaataagcacaatttttttaatttcaaatatcttgcagcctcggaggaagaaaaagatatgggcatatgtaattatataacaaaatagaaccagaaattttagaaaatgtgatatgtgagttatataagggaagcatgccatttggggaatcaaaaaaagaacaagattacagaagaaatgtgagattactcagttctttcttttttctggtcatggaaaggttcagactgaacactgaaaattttttggagaccagctgaaaaaccatgccatggtcataatttgtcattttactttttatcctcactaatattcatgagtcctcaatctttatttttagattccatatctaaagttaatactcaagattatcgatggtattctaaactaagttttgtacaatgcacttttctgaacatctaagttatctgaaaacaacagttgtgaccttcattactgttatagatacagagattaataagaactgatatagaggtgggtaaaaccattgatatagagattcgtaagactcctggtcttagaggaggtccatccattaaaggaagtggattcaagaacatataaatctaatatactgtaatagcacaatgtactgggtgatcaaaaagaggcccttgtttgaaaatatcacacatttctgaaaaccatgtcttaaaacaaaaagtgaaatatctagcatagtgtgctaatcttttcacctctgaagacaatagaaaagattaaattagtaagtaaaggagagaagtaataaagaaaaaaaaaacagaaatctaaaaccaaaaacttagtaagcagtactaaaagaatgtgtcaaaacatgaaggccagcttatcaagagaccatccaaatgctacctatataaaaatgaggaaaaatgcaagcatggctattgggaatcacaaggacagaatttcactcatatcacttcaggctgatgtggtcaaattgattaggaaatgctggaaaatgggtctgcagagtactagccaattgatgaggcagcattctacagggtctcaatctaatttagtattaaatactaattagcatcaccaatttcagttcctgatataacagagtaatgaataccagatcaaacttcctgccataaacaactatatgactagaagttaatattttcagacatggataagagagaacacaaggctgtgatctgtgaaagaaaaacacaccaagtgagatccatactgatcctgaattgttgccagagggcacatttcgagtcttgacatatggagtggagcccatgcaaggaggagcattctcagctggatgaaggaaacacattggactacagagattgtgaggggcaggaatctttcagcagggaagaggacaggaggacgctctgcagataaggagctccagaaatctgcctacgagtctcctagactgtagtgagtattacagtgtacataagcaaggctagactttgtgaggtctagcagagaataacttctggggaattgtgagctgaatagagtttctgaagcctgcataatatggggaaatactgtagttctgacattcagagtggagagactttcctaatgcctcaagcattcagctgaaatttcataaaaattgcaaataaagaatagggatacacgagccttaaagtagtctttagacccattctaacaaagccaaatccaagtctccacagcataaatctgattctccagaaaattaactatcctctgttagaaagagacaatgctttttaaagaaagacaataatatttcagctctaaatatgaagtgaccacaatgtacatcagaaaataaaataactactagaatgtgaagcaggaaaatatgacacataattgggaagtataatgtcaacagatgtggataagactgatgctgtaattagcagataaagattataaaagtagctatcataaatatgttcaatttttctcttcaaaaagataaagtaagcatatacttatttccttgatgagattatataatctcattaaagaaaaactacaaaaaagaatagaaattctacaactgaaaactacaagataaatttttaaagaaattataggctgggcgcggtggctcacgcctgtaatcccagcactttgggaggtagaggcaggcagatcacgaggtcaggagatcgagaccatcctggccaacatggtgaaactccgtctctactaaaaatacaaaaattaactgggcatggtggtgggagcctgtaatcccagctacttgggaggctgagggaggagaatcgcttgaacccgggaggtggaggttgcagtgagccgagatcacgtcactgcactccagcctggcaacagagtgagactccatctcatttaaaaaaaaaaaacaaaaacaaaaggaattgtatagccttatcagtagatggacaatgccaaagtaatattagtaaactcgcagacaagaataaaaggagtcatacaaactaaaacaaaacaaaaaactgtaacaaaaaaaaagaaagaaaagagcttcaatgatctgtgagacaatgtcaaatagtccaaatagtctaatgtataattgaaatgctagaaggagaagagagagaaaaatttggcaaaaatattatttgaagaattaatgatccagctgctgaaaacttattttactattttaccgaaaataaaattttaaaagctgtcagaaaaggtacattacatacaagagaaaaatgataagagttgttgctgacttatcagaaacaaggcaagtaagaagaaaaggggacatgatagggctgaaaaaaactcttgttcagcccagacttctatacccaacaaaatatctttcaaatataaaggtaaaataaagacatttcagtaaaaaactaaaatgaggagaattttaaaggcaagaaatgtcataatatttttatgttaaaggacgatggaacacatatctagttgaaagaatgaattgcacaagaaatggtaaaatgtataggtaaataaaacttgtgtttcttggagagttaatattttgaagagagactgcagtaagttaaacatgcacattataatctctagattaataaatagtaacctaaaaaggcatggcaaaaatgtcaataaaggagaggaaatagaatactaaagattattcagttcaccaaaaaggaggtagaaaaggagaagttgaagtaacagagcaaacagaacaaatagaaagcaaaaatgaaataacaaagagaaaatatagaaaagtagaaaataaaatcatagtgtgcttaatctaaattgtaaataattacattaagtgtcaacagactaaatggcccacttaaaaggcaaagactgtcagattatatttaaaaagcaagagtctggctgggcgaagtgactcacgcctgtaatcccagcactttgggagaccaaggcaggcaaatcacctgaggccaggagttcaagaccagcctggctaacatggtgaaaccccgtctctactaaaaatacaataacgtagacaggcatggtggcgaatgcctgtaattccagctactcgagaggctgaggcaggagaatcgtctgaacccggaggcagaggttgtgatgaggcgagatcgcctcactgcactccagcctgggcgacattgtgagactgtctcaaaaacaaatgaatgaataaataaataaatacaaaaattagctgggtgtggtggggtatgcccatagtcccagctactgaggaggctaaggcactaaaatcgctagatcgttagaaccgaggaggcggaggttgcagtgagctgaggtcgcgccgctgcactccagcctgggtgacagagttagactctgtctcggaaaaaaaaaaaaaaaaaaaaagcaagagtcaactatatgctgtttataaggaatattctttaaacacaaagacacaggtcaaaaggaaagggatggagaaaacatcatgaagatgttaatcatgtagaagccaatatagttatatagataccttacaaattagacttcaccaagtaatgcattatcatagataatgatgcatattttataatgttgaaagtgacaactcatcaagaagacataaatcttaaatgtgcattcatttcacagaaaatctctcaaactctcaaagtttctaaactaaagggagaattagatttgttcacaatcgtagttaaaaacagtaacaccagtctttcagtaattgttggaagaaatgaacaaaagtctgtaagatatagcagttttgaataacattataaatcatcttgacctaattaaaacattacacataagaactgcaggatacatattcttttcaagatagatcatctactagtttatttcagactatcaataatcacatagattgcattctctggccaaactgtcatacattaaaagttaatcattattttaagaaaatacgcacatatttagaaattaaacaacacagttctaaaatacttatgtgtcagacaaggaagcccaatggaaatttttaaaaattactgaacataaggaaaatacaaacactatgtattaaaatttgtagaatgcagttaaagcagttcgtctgggggaaatttatagtgttacatgtctacattagaaaggaaaataaaagctataaaagcaatggtctaagatttcatcttaagaagataaaataaaaaacaaattaaattgaaagtaaatgaaagggaatgttaaaaatgagagtgaaaaaaagacaaaaaaaaggaaatcaacaagatcaaaatttgaagaaaagattagtaaaattgattaataaaactcatcacgatgaaaaggtaaaacaagaatcagcagtatcagaagcaaaagaagggacctttctacagacattataaagatgataaagaaatattatataattttatgctaattagttttacaatatagattaaacgggcagattccatgaaacaaaacttagcaaaactaatagaacaggaaatggaaagtgtgaccaaccctgtatacattttagaaacttaattttaattaaataattcttaggcacaaatggcttcactggtgaatactatcaaatatttaagagctgtacaatatccatttagcatattctttttcagagaatagagatggaaatcttcgcattttattttatgaaaatagcatatctttgataccaaatccagacaaaggggaaaaaaacccctcaaaatcctgaccaatacctctcatgaacccagacacaaaaattcttaacaaaatattagtaaacaaaacccaataacacatttttttaaaaaaaggttctatataatgactaaatgaatttagtacaggaattcaagcttggctaaatatacaaaattaaattaatgggatttactccattaaaatattaaagaaaaaaagcatataatcatttagattggctcaaaaaatctatttttaaaaactaaacagtcaatcatggaaaaattcttagcaaactagaaatggggggaagtcttcaaactaatacaatgtatctgctaaaaacttatagctaatgacataaatgattataaaatattcaacacttttcttctgagatctagaaaaagacacagatgtatattgacagcatttcatttaatattttactagaggtcctagatagttcagtaaagtaataaaaataaatggcatagagattgtaaagaggtaaagccattgttgtttatagacactgtgattgtgaacacatacagttctaagaaatccgcagaagaaaaattcctgtgaaactaaagtgaattcactaatactgcagaatacaatccaatctagaaaaaaattcggattctatataccggcaataaacatttgaaaaataaaaacaaaaatgtcattcaaaatattcaaatcataaaacttttagggttaaatttaatgggtggtgtgcaagaatgctctgctgacacaattaaaatattgctgagagaaattcaagaaagtccaaataaatggaatgatataccatgcttagggtttggaaggctcagtattaataaaaagtcttttatctttaaatagatctaaaaattcaatgtaattcttatcaaagtctcagaagccttgtatttttaacagaaacaaatggattctaaagtttatataataattcaaataatctaaaatggccagaacaatctaaagaacaaagttggataacttaaaaacttaccgtaaagcttcagtaatcaaaatagtgaggtattcacattaatataagcaaatagatcaatggaacagaattaagagcccagaaatagatccatgcttacatactcatatctgtgtgtgtgtctgtatgtgtgtgtgtgtgtgtgtgtgtgtgtgtgtctgtgtgtatgcaaaggtaccaaagcaatacaatggggaaaataagctctttccaacaaatggtgctgctgcaactagatattcatataggaaaaaataagcaaactttaacctctacttcatatcatatcattttcaatgaaccaggataactaaaactataaaaagtatacaaaaaatgtacaaaaagatctttttggtcttaaggtaggcaataatatctgaggcagaacacaataggcattaaccattaattgaaaaatgaataaattatatttcatcaaaatgaaaaatcttctcctcattaaaaggcctttgcaatgtaaagctatttgttgctccatggttgcctgaatgccagcacccacccccacttgttttgaacttttacctagtcattgcccatctctgggtactcatccctaacatgtatattttcaagcaataagtctcatgatgacttcaccgttttaccccttctttcctttccatagtaactcagttacattcaaattacccataagaaggcttcctgcatgccacagctacttcacccatgaccctcagtaaagccacttgcctagaggtccttattctgtttcctccctgcctgccacaaacgtttggcttttgggtgactttgcatggccctctgagcatgtggtgtctccttctctaggacctatgagtataataaatcctttaatttcttatgcctctccagatataatttccgtgaccatactggagtgaaccttaaagaccccacaaggggtatttcctcccccacttatgacacagccttaatgagaaataagcctgtaacagatagaaaaaagtatttgcaaaacatatatctgacaaagaacttgtacccagaacaaatatcttagtaatacaaaataaacatcttaatattttttaaacttttattttatatttaggggtacatgtgaatatttattatataggtaaatttgtgtcattggggtttgttgtacagattatttcatcacccaggtattaaacctagtacccaatagctatcttttctgctcctctcccttctcttccccaatcaaatagaccccagtgcctgttgttttcttctttgtgttcatgacttctcatcatttagctcccatttataagttagaacacatggtatttggttttctattcctgcatttcataagaatgaaaacagaaatctcacgaacgtctcaataaatcatctatgtctagaataccccttctctgtctcctgagttcaataatatattctacttaaataactgagaatggacggcaggccttatttgtttacatggattccatgaaatgcaggagctacattttctgttactgctattgtttgttagggattagtacccagagatgagtacccagcgccatccgcgatcctgcaaaagacacggtcctgttttttaagactgcatagtatcccatggtatatttgtacctcattttctttatccaatctgtcattgatgggcatttagattgattccaagtctttgcttctttgctattgtgaatagtgctgcaatgaaagttcacatgcatgtgtctttatgttagaatgatctatattcttctgggtatatacccagtaatgggattgctgggttgaattctagttctgcttttagctctttgaggaatcctcatactgctttccacaatggttgaactaatttacacccccaccaacagtgtataagtgtttccttttctccacaccctcgccagcatctgttattttttgactttttaataaaagccattctgactggtgtgagatggtatttcattgtggttttcatttgcatttctccagtgatcagtaatgttgatcttttattcacatgattgttggctgtatgtgtgtcttcttttgaaaagtgtcccttcatgtcctttgcccactttttaatggggttgcttttcttttatacatttaagttccttatatatattgggtattaaacctttgtcagacacacagtttgcaaatattttcctccattctgtaggttgtctatttactgagagtttcttttgctgtgcagaagctcttaagtttaattagatcccatttgtcaattttgcttttgttgcaattgattttggtgtctttgtcacaaaatctctgcctgttcctatgtctaggatggtattgcctaggttgtcttccagggtttttatagttttagattttcaattgaagtctttaatctatcttgagttggtttttgtatatggtataaggaaggggtccagcttcaatcttctgcacatggctagccagttttcccagtgccatttattgaatagggagtcctttccccattgcttgtttttgtcagctttgttgaagatcagatagttgtaggtgtgcagcatcatttctcgactttctcttccgttccattgaccagttacttcacaaacagttatttacaactagacaacatgcacgtgaaaaactattcagcatcattagccatcagggaaaatgcacattaaaaacacaattgattatcactacacacccaatggaatagataaaattgaaaacactggtgacaccaaatgctggtgaggtgaaacaactccaatacccatacattgctgttgcaagtataaaatggtactgccattttggaagttctgatagtttcttaaaaggttacagatatacctaccataagattcagccttttcactgttaaatatttacccaataaatattaaaatctatgttgacataaagacttgcacacaaatattcatagtatctttattgatcataaccccaaactgaaacaccccaaatggtcatcaaaaatcaaaaggaaaatagataaactgtgatagaatcgtacagtgaaatgctgtctggaagtaaaaagcaaagatcgattgacacatgcaacatgcgtgaatctcaaaaacatgatgttgagcaaaaatgtcaaacagaaaaagaatacatattaaaggactatattatatgaaattctaggataggtagaactgacctatggtgaaaggaatcagagcattgattctctctgagagagtggttgattgagaaaggatccaaggaaattccctggggtaatgaaagtgttatatcttggtggaggtgtattacatagacatttacacttgtcaaaattcactgaattttacagctatggcatatgcatttcactgtaaataaataatattttcatttctacaagactacccatgtgattagtaataaaacctgatacttgcttctgcctttcctaggagagccatttaatttcttttctcccccattactgggatgtacaacaaatgataatcaaaatagcagattttgacagtactgaaattggtcagaacactgggaagatactgcataagacaaaagaactcacttaaatgataagaagaaatgggctgaattcagaaaaccagctgaatttatttaatatatttttccctaacattttctacagtaagcccaacatgatgtaatatatgagggtattaagaagttaaggcacacttggaaaattgccattcagacttatagattaaacaaatatcagatgtggaactacattcttaatcatgaaattttaacttatactgtcagactatacaaattatttggaacatttcctccctcttcaaacatttagaactataggggccaggtaaacatcaaggagaaattatgcataaataatacaggcactgtgctttcacagagtgtttttcctggtatttaacatttgccagtgtgtctactgtgtgcaaccttccccctcaggatttagctgtggtggcaataaaggcagtgaagttaggaagactctcatcactactatcaacagccacattgtgttcagcttcttggttgacttaaattgtgcaatcagggtctatccacacattcagctatattctgtcacttatgatggagccttttgtgtctatgagttaaaggtgtccagggagggaaatgtaatgccctgactcattccaacctttaaaaacaaagcattaagtcaagaatatagtaaagaacatcccagtttcacatgttcaaactttggttgaactaatttgtaactgcaaagaccattccaaactgtgtctagtggtcaagactcctttatgtctctttctctatttggaatgttttctctctctttttccctgatggttaaagccctactctgccctactcttcactcaagactggcaaataccacaaccttttcccaataaattacatcatcaactttaggtattttaaatatatttgctcatgtctcttttttacaggactaggagctcattgagggcaggtattttgtaatattaatctttgtccctggggtctggttcacagtacatgtcaaataactgtttgatgagggaccaatgacccgtagaaagcagaaattttgaaataccatcactcctaaaattagattaggtgccaactttataaagataatttcagcttaagatattcagttatgttttagattattttttctcgagttttcctctacagtaatattgctttttatctcaagcctaatctactttcacatctttgagtctgctttcaattttttataggaaatttttttttatatttcattttaaactcttttgtgttttatatttggtcacccttaatagagtgtgccatttatccaccatgaaactaactctgtccagattactcaccattttatgttccctgtcagctttcttcacatcagcaaacctgaacacttttcaagctatattcctatctagggcattcataacagagagtggtttctgtcatcatgaataacttttctttctttcctaaaaacaaattggggattattgtacacaatctctctcacataaggctttctgatttgtctgatttattccagtatgatatgcaatatcaaaagtacattggaaatcttaataaattatctgtacctagagtacctcttctgtctcttgaatgcaataatatactctacttaaataactctgagaatggatggcaggtcttatttgtttttgtgaatcccagtttacaaaaaaataaaaaaggtgtttttttttccagatgactgcatatgtatttcaccttttatttgtttactttttattgatttaaagtcatatacaaaagcaaaacaaaataagacaccatgtctggctgtatatcaagcataaaaaacactataattaggtaaagtttcagcaaacaatcagcaacaagatggtttagttcctggacaacaataatgaaactcaatgactttgttagtccctcacactgtcatgattggagataaaatttttaaaatcctatgccaacaaatcaaggacagtagtgtcactgcttgggtggcaggggaagcttgccatataaaaaggtgaaagaccttttcaactattttggtaagagcacctcaccttgatttctgttctttttggcaaatatttccaacacgaagtctctatgcaagagttgactttgaatagtataactatcattactattgtatttgattatcttccccaaattattcttattctagtgtttttcaagttttaatgaattctgattctattagactactaatgtaatgaaagcactctaccctttcaccaagaaatgtgcatctataattctctatacaatctcacagaatagtatgatgggaaaagagatacaaaacaaacacaaataagaagaaaccatgcaaatacatggaaattaaataacctgctccttttgggtcaaaaacgaaagcaagatggaaatgaaaacattctttgaactgaacaaaaataatgacacaacctaccaaaacctctggaatacagcaaaggcggtactaagaggaaagttcatagccctaaatgcctacattgaaaaggctgaaagagctcaaactgacattctaaggtcacatctcaaaaaactagagaaacaagaacaaaccaaacccaaacccaacagaaaaaaggaataaccaagatcacagcagaactaaataacatagaaacaaacagacaaaaaatacaaaagataaatgaaacaaaaagctggttctttgaaaaaataaataaaattgacagactattagcaagattaagcaagaaaagaagagagaaaatccaaataacctcactaagaaacaaaacagtacatattacaactgacaccactgaaatacaaaagatcattcaaggctactatgaacacctttatgcacataaactagaaaacctagatgagatgaataagttcctggaaaaatacaacctttcctgcttaaatcaggaagaattagataccctgaacagactaataacaagcagagagattgaaatggtaatttaaaaattaccaacaaaaagtccaagaccacacggattcacagcaaaattctaagaattctaagacattcaaaggagagttggtaccaatccttctgacactattctacaagacagagaaagaaggaaatctccataattcattctatgaagccagcatcaccctaatacccaaaccaggaaaggacataaccaaaaaagaaaactacggactgatatccttgatgaacacatatgttaaaatccttaacaaaatactagctaactgaatccaacaacatatcaaaaaaataatccaccatgatcaagtgggtttcataccagggatggagggatggtttaaaatatgcaagccaataaatgtgatacaccacatatgtataattaaaaacaaagactacatgatcatcttaatagatgcagaaaaagcatttgacaaaatccagcactccattatgattaaaactctcaacaaaattggcatgcaagggacataatgtaataaaagtcatccatgacaaacccacagctaacataatacagaatggcaaaacgttgaaaggatttcctctgagaactggaacaagacaaggatgcccactctcaccactcctcttcaacatagcactgggagtcctagccagagcaatcagacaagagaaaaaataaagggcatccaaactggtaaagaggaagtcaaactgtcactgtttgctgatgatatgattatatacctagaaaaccctaaagactcctccaaaaagctcttagaactgacaaattcagcaaatttccagatacaaaattaatatacacaaatcagtagctgtcctatacaccaataacaaccaagctgagaatcaaatcaagaactcaaccccttttacaatagctataaaaaaacaaaaatacttaggaatatacctaacaaaggaggtgaaagacctctacaaggaaaactacaaaacactgctgaaagaaatcacagatgacctaaacaaatgaaaacatatcccatactcacgggtgggtagaatattgtgaaaatgaccatactgccaaaagcaatccacaaattcaatgcaattaccatcaaagtaccaccatcattctttacagaactagaaaaaacaattcccaaattcatagggaagcaaagaagagcccacatagccaaagcaacactaagcaaaaaagaacaaatatggaggcaggtaccacattacctgatttcagactatactataaggcaacagtcaacaaaacaacatggtactgatataaaaataggcacatagaccaatggaacagaatagagaacccagaaataaacccaaatacttaaagccaaatgatctttggcaaagcaaacaaaaacaaagtaaagaaagaacaccctattcaacaaatggtgctgagatatttggcaagccacatgtaagagaatgaaactggatcctcatctctcaccttatacaaaaatcaactcaagatggattaaggacttaaatctaagacctgaaactgtaaaaattccagaagataacatcagagaaatccttgtagatgttggcttaggcagggatttcttgaccaagaacccaaaagcaaaggcaagaaaagaaaaaaacaatgataaatagctgagacttaattaaactaaaaagcttttgaatggcaaagggaagagttagcagagcagacaacctacagagtgggagaaaattttcacagtctatacatttgacaaaagaacaatatccagaatctaccacgaacttcaacaaattagcaagaaaaaaacaaataatcccatcacaaagtcggctatggacatgagtagacaattctcaaaagaagatacacaaatggccgacaaacatgaaaaaatacttaacatgactaatgatcagggaaatgcaaatcaaaaccacaatgcaataccaccttactcctgcaagaatggccataatcaaaaaatgaaaaaaaagtagatatcggcatggatgtgctgaacagggaacacttctacactgctggtgggaatgtaaactactacaaccactatggaaaactgtggagattccttaaagaactaaaaatagaactaccatttgctctagcaatttcactactggatatctacccagaggaaaaaaagtcattatatgaaaaagatacttgcacatgcatgtttatagcagcacaattagcaactggagaaatgtggaaccaacccaaatgcccatcaatcaatgagtggataaagaaactgtgatacaaatatgtatatgatggaatactacttatgatggaatactacttagccataaaaaggaatgaattaatggtattcatagcaacctggatgagattggagactattattctaagtgaagtaactcaggaatggaaaaccaaacatcatatattctcactcatcagtgggagctaagctatgaggatgcaaaggcataagaatgactcagtggactttgaggacttggggaaagggtgggaagggggcgagggataaaagactacaaatagggtgcagtgtacactgctcgggtaatgggtgcaccaaaatctcacaaatcaccactaaagaacttactcatgtaagcaaacaccacctgttccccaataacttgtggaaataaaaaaatttaaaaaaatgtagaaaagattttaaaaaaggatgaggaaatatttacttaataatccattcaacaaatatttattcagaatattctatgtgccagataaaagcagaaaataaaaaaaagacagaaaaactgcagatctgactaccaaatctgatattttgttctatggaaaaaagtaacagcaataaataacaactcaaaatagataaactattcaccaaggcgattaagagaggggtacagtaaaaatacatgaaaattaaaattcaagggaaaaacaaaatttgagggaatttgtcatcagcagacttgccatgcaaaaaatgtgaaaataagttcatcagaagaaggtaaataatataggtcagaaactcaggtctatataagaaaggaagaatgttatagaaagaataaatggtaaaataaaatcttctctgcttcttattcttcaatactctaatagataagtttgttcaaaataataatgtatcttgtgactataatttatgggtgggtgaaatgaataatagtaatgtcataagggaaatgagggaagaattgggaatattttaagaaacttgcactacctgtgaagttgtatagttgtatttgaaattgaacttggattagttgtaaatgtattttgcaaaccccagggcaaccactaagttaaaaaagaaaaagaagaagtctggttaagagacagaaatcgagttgggttttagacacaaactttgagaaacttattaaatatgcaagtatagttggtggggaagatgaagagaaataaggtaagaaaatgaaatgaagcagtcagtaagataggagaaaaaccaagagaggatggtttccagaatgcccatgaagaaagatcctcataaaaggaggttaaaaagtacatttaaaagtatattattagatgttgagtacctataaaacagaatttaaacagtggttgttttggtgtggtggtttttgtgggtgatttaattttttttccattctgtttctaccttttaaaactgtcatgcagtaaatatgcaacactgttgtaataagaaataaaataaaaatcatttttaaagtattgggtcctttactcctacctaagaataaacattctttatttttacctttctactagtgtcaggttctaagtacaatacttagagatacacatattatagggaaatctgttggtaaaaatgtcctagggcacactgttcaatagagatacaataggagatgcatatataattttaaattttctagtatgcacattgaaaaaaatgtgaaattaatattttattaacttagtatatccaatgtattatagtttcaaaaatataaccaatataaaaatattaatgagctatttcacctttttttggatgtctttgaaatcctgtgtgtacttcacacttatagcacatctcaattcatatttaagtgcttgacagttacatgtggctagtatctaccatattggacagtgtgttctagatccttgttcttcaaaatatggttcacagatcagctgcattggcttcacccagaaaaaaataaatgcagaatcttaatccttatcctggagctactatatcagaatctctgtttcttttttttttttttttaacttttaagttcagcggtacaagtacaggtggtttgttacctaggtaaatttgtgtcatggcggtttgttctacagattatttcatcacccaggtattaagcctagtatccattagttatttttcctgattcctttcccttctcccatgctccaccctctgaaaggccccagtgtgtgttgttcccctgtaagtgtccatgtgttctcaccttttagcttccacttataagtgagaacatgtggtatttggttttctgttcttgtgttagtttgccaaagataatggcctcaaaggaatataaattattctactataaaggcacatgcatgagtatgttcattgcagcactattcatgatagccaagacatgaaatcaacctaaatgtccatcagtgagagactggataaagaaaatgtggtacctataaccatagaatactatgcagctgtaaaaaagaatgagatcatgtcctttacagggacatggatggagttggaggccattatccttagcaaactaacacaggaacagaatctgtttctaacaagcactcaaatgatactgttgcagctcgcttcacagaccacactttgagtagcaagactaattatatccagcccaatcattttctagaagctcttcagcagttccttaacctgttttctgctgtaatcctctcttcatgtccatcattcctccaaaaagcaattattatgtgctggttactgcgtgctaatgctttacaagttctatcatccacattttacagaagagaaaacagaagcactaatagattatgtaacttgctcaatatcacccagctagtaattagtggagttgggatttgaaaccaactagcctgcttccagaatccagtgtcttaaccaaccattatttgtttatatatctgtctcttctacttaagatacatctagctcttcaaagatatatagcttatacatcttttttctacaactatttaatacagtaaatgtttttgtaaagaagggagggagggatggcttcatttgtgttttcctgctaggactgcccttccaggtccaattgccccagaatttccagtactcaagatccctgttttataggtgctagtagacatattattgtgtggaagccatggtcagaacacctgccaggtgctatcactgtgtctatcatttcacattaatattaagaaaacatttatgaaattctataatatccaaacagaatttttgctaaaatgttttcctaattaaaaaaaaattagtataaatgataacctaacaggtctgagttttacaagtagaagttttgctaatcagtgaaatgcccataaaggaagtaggagaggagacagtacaaaactgagataattctaagtccaaacaaccactttcttgatatctaggtggtaaattttattgtacatcaattagtgatcctcttttcagattctcttttcattctaatcaatctaattccatttacatttgctcagttaacatgactgctttttggaaagggtccaattcttcttcctttggaaatttcaactctctatttctcatttgactgcaataaagtggctgggatgttcttgagagttatgggtagggaagttctttgtacccttaggtggatgcacgctttggctgtcaacacctagttgcttttcgtaggaggtgctgccaggtcagaaaaaccacttgtatcatagatggccccagtctttgcctcaaataaaacagataccagaaacagggagaagaatctgcccttttctgagaggtacaaagacgaccatggtgtgcatataccctcaccacttaagggctgtgtgccctcgggcaagttactcaggctctctgaacgttatgtttttaactgtgtcaacgtgaactagataaacactatgaatctcaggttccatctgtaatttggcattttgacttatcacctagggtttctgacagcaatgagaaaaatgatggaaaatgtagtgcagagtccagcacctgacaaataataatccattagcattttccttcaatatatttcctactgaactacaggaattttgaggcctcaacttgatattatccctattttaaactttctaatggccagctgcaaacacatccatgtcaactccctccaaaatgttatttgtcctttagatctatttcagatgtatttcttgctgaataatctttgtatgcaatgacccctgtatttacttacaactacatcatcaacatcctaggacagggtctaggttagtttcatttcccttcttgggcatttactacaatgccaggaataaacaggtgcttaataaatgccttttgttaagccaaacgtggtggctcacacctgtaatcccagcactttgggaggcagaggtgggcggatcaccagaggtcgggagtttgagacaagcctgcccaacatgaagaaaccctgtctctactaaaaacacaaaattagctgggcgtggtggcacatgcctgtaatcccagttacttgggaggctgaggcaggagaatcacttgaacctgggaggaggaggttggagtgagccgagatcacgccactgcactccagactgggcaacaagagcgaaactccatttcaaaataaataaataaatgccttttgttgatgctaggcattcctaaagtctttggaaaactttccataaccacccctcctctgcccactccagctctgccctctcacctatctctgcggccctccatcacagaccttattcacttaactgcaaattgggcactgttcctttgtttttattacaaaacatttctaacataccaagaagtaaaacatccgtgatttactctaccactcaatttttcatgaatgttgacattcgttatattattttggttctggtttttaaagatctataaatgtttctgatatagctgtgaaccttccaatcctattctcttcctccctccttggaggcaaccactgtcctgttgtgtccataagtttcatttttgctttactataaaaaaaaggagttacaatacccctcttaaagggttatgaggcttaagcaaaatttatactgtgactgacaaagagttaaaacaatagtagtctctgtcatcctcatcatcaccatcattgttatcctcactcttgaccttattatttttctctgcatattcatatgtctcctccagtaggtctttgcttttctgagatctggaactatttattttctctatatgcctatagcttagcccagttcctgatatataggaagtacacaaaacttgtaaagtaaatacatgctgtaaaggctggactgattaccttccattctctgatttcaggcataatcttaaagcacattaggcatagttcttcaccagttctctaaaatagtaacttgaccagaatatgcaggctaatatccattcaccctcaaaaatccagagtaatgacaatctctttattctttcaaggggccctgatcacctgattgttagtatcacatattcatctccaatacctgacaccagaaaaacaaaaacaaccaggacaaaactaaggttcccaaagtccagaggctgaactaaaagataatggatagatgagcactcagtcttctggcatcctcaataccctctcagccttttagattgttataacccaacttgctgtttccttttcaattatcaagatttacagaataaaaaaaggtgaacttgtctttaaaaattattcgcgataaaattcgattttgtttacttgatgctaaatactgataggcaaggaagtggcaggcaatcttactcggtttcccccatacactaattaaacattttatgcagatatcagcataattaaagaattaggaaacaataagaagtgcttgggataatttgtaatatcagtgcactgatgcattgggtccagataccaggatttgattggcaggactttattaagttttggcagcacttaggtagtctgggagcttttttatgaggctcgtgcacattaatccaagctcctgttgtcgttaatactgatgagtgaaggcagttaattgaattatgtatgaagcactgctgattaaataatatttcactccccactacagaattcgctctgctggattaacatctactgttgtctctgacactgaatgttatacggacctcttctgaagcatacactttgattctttcccatctgttcaactgatgcagcatctcagttgccactggaaccaactatccttcagctctgacatgaggtcactttggagaactgatatagttatttattagcatccgtgtaaccatgaacagaaatcctccccagtgcctcaggtgttctaagggcattattatttaaattcacggtggaatgtgaagaaaaattctaattatttatcattgtattctgcttaaggtgataggaagagaaaataactcaaggtcttccaaatcagccttaaaaataagtattattttgagctgcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatattagaccctaaaaacacctacctcattatatccatatccatggtagagttttgtctgtcaaggagaatggctttaataagatgggccagaaacccttttctaaaaacagtgttaaagaatcacctctcagactttattttcttctagacttttactactcaccaattttccttttctataggtctttttttctttcctatagtttactacaaaagatgcgtgaatggaactgaatgtgatggcaacccagagatcaacaaataggcgtagccatataagaagaaagagaataaaactgataaaatatcaagattatggttgatacacaaagttatcacagaggagtaaaaccatgtaatatgatttattgctcacatctcaagttataaaatatttggtacaaacaaaacaaccaagagaaataaaataaaacccaacacccagcatttggattattagaaaaatgtcattctttaattaaaattgttaattgcttttatgttgtgcttcacgtactacaaataagttaaaaaaatagggaataagatgcttgaaacacaaatgctgaattttatttatatggggtagcattttttaaaaaaatatgcaaacaatgatttaactaaataattgaaatttggtcattaggagaagacatcattcaaccattgagaaaattttaaaaacctcatcaggccactttaacattttcctgaaagttatattaaatccttacatttggtgacattccctaaataaggggaattgggtctaacaaaaagaggatgtaaacagagaaaagtatagccaaggttaattccaaaatttctgtaatatctgagaaagttatgtgttctttgtgcaaaggttctctgactatccaggcctaaggatgactcaactgagatggttggattttcagaactgaattcctgtgttattcttgctttcaaacttttccagtggctgacttttagcagtggaacctaactgggccagcttttgtgtctcctcacatattacatttcttcttccccaaggagctgtcatttttctccttcttgaaataaattcatctaaagagaatttctctcaatcaacttcccatcattctctctggagtcttcagaactcactattatactgtcaaaagcctgccatccatgcattcactcaaacacaactattgaaagcttaatgataatagtagttactacttaactgaactcctcagatatgccttgtcacctgtactgtgggttcagtaataaataaagcatttttgtccttgaggagctcccagtaaaccaagagaggcaaatatgtaagtagttattcatgtcagaggaagagcaccaatgaggaagcagctcattcaaatggtgaccctcccacattccctattcatggtgtcatcatccatcctgtcctccacacttcacaatcatacccctctcctctttcacctttttatattaaatggtgttttctccttcagaaatagctcatatctcttctgtaatgaactaggtcctccacatctctagcctagacaattacaatcacctctttgccactagtatcttccttccttaaattattattatttttaagcggtgctggttcaaaaatttccatttggtctgacttattcacaaaaacaagttcaatctcctcgacatggcccatggtttaaatcttcccagtgtggccctcttatatttctccagcctaatttcctatctcatatttcaggatacacaaaactttccttaattccctaaacatgccctcttctttaaattatctgtagctcacagcatgtacttttctctacttggtaagaatttcttcctgactccatcttcttcataaaaatgcttattcagttgatcagaaatcatgcccacttggcctttttgacacccaccttgtaaagggctaacagatggctacacccaaccacagcagggtaccccaaatgagagcaaaaacttaccttgtaaataacagctgaggaccccactccagccaaacacaaaacaatcacaggtgataaaaacgtcaccaagagaacttctgtaatatgcacaacaatttcccccagatctaaagatgttaataaatttctgaaaatatctaactttctcacagccaacagatgtaggctaggggttcagagcttctaggtgacagatattagattgtaccttaagcttcatgactttcaatccctctgtctggttggtacctgctcagcctttaagttttggcttatgttcaatgtcctcaagagatctttctagatgttcaatccagattgatccccgctatcatctttctcatagaatctggttcttttccttcatagtacttacgctaatttaccattgtagatctattatttgttggctatatttttctgcacttgttcataagctttgtaatgagtcattcatccatccatacctagcgctgttttgttcatccatgcatacctagcactatcctggcacagagtaagtctcaataagtatgtgtagaataaatataattccattttgcatcatgccaggtgacataaaagtgtaaaaaagtagtagatggtatgttcttagtttggtccatggataatcaattattgatgaaaatctacttctatcagggtagctaaatggtttccaagagttttgtctgtatgaggaacctatggataccttgagacaaagaaggaaaaaagtactttgaaatttgcaatcatgctcagcaaagttcttctcacactctccaggggatggaaaactcatctggaggtagaagagagttaagctgtccaagattctttcatgaaacatgttgatttttgtgtgtgtgtatgtgaggtgaaaagaattttagatgtaacacaatgttgagacaaatgttatctgactcaaactgggagaaatcatatttaaaatagcatggtctaaaaaattaaaagaacagggcaatagtttcagggatcatcaaagaaaactgacaccactgagtaaacatcgcaccagagtcccagtgaaagaagcactcagagtaatggaagaaagtcaacataagctgttgtaacaatgtcagcctcctgtgataaccctaaggtcactttcctagtgggaaccaagagacagaaacatatggggatcatggctatcaagtggcaaactggaaagcagcatattaactgtagtatctgccaaggtaaaagataggtcgccctggacccagcccagtgcagacagacagaggaaggattgggatgctaagttgttccattaggtggggacccaggtcaaagcctatgttctttacagaaccatgtcctttgttcacccaccctagactgctacatactggggatcaaggataaaaatgacttctcatgggagtaaatgaaggaacaatgaaagtagtataataattttgtgcttaattacacattcagactgcaggtgctgtagatagctagtgacaagagaatggccatccagaaaagaatgggatacaagtatttgccctcctgcagttcttcatggagtgtagtcagccaagaataaatttaactttactttcttttaatgcctgtccctgggaatttcttatcccataaaacaccaaccttataaaattagagcaccatccctttttcctcgagtggatttctcttctcattttccttttattaattaaaagataatgctctaaactctggcagtaccccttttcactgtgggctcccctggcccactttctgcagtatatcaacttatttatatttatttgtcctaatacctatgttttcaattggtttctattatgcaacacaccacagggaaagagtctagtattaaaatcacactgtgtagtttaattccactttaatgctaggactctggttttaatcaacttattttgatcacagaataattctcagtaataatccaggggtgtcaggcaggccatcagctgagagtaatcaaatgagtctctccacctcttctctctctcttccatatagaatagtgcatttcttccacttcacataaactggagctaaagccaggttccaaattagtctcgtgaaattgtaactgactctctattaccaacttgtaatgggaattaatggagtgaataatctaaaatcatgggtggttctgaattaatgatacttgtcttgagtaacacaatatatgctttttccctccaaaagatgtacatttcttattaatgatgttttcttgatctctaagtagacatcaagaaaaagaagatagtactttttagaatgccaagcaagcgttgtttggggtactttgtaaacactgtcttgtgcaatcactccatgaggaaggtattcttctagtttatggagtaggaagttcagagcagcagaggattgtgggaaaacctctgggctaagagttagggaaaacagttctagatcatcacacaggtattgaaaatgaaggatatgtgttgcggcaatgtagctaagttggaattttgtttttaaaatgttcttttgctgcagttccgagttagtgtgggccacaagagacattttgtgtgggactggaaggcagaagtaaggtgtcagccatgttctttttatgtgggcaagattggtgttgagtatgaggcactggtgtagtgcacaagccttgtcacttttctgccagcctgagttgtgagtgtggggcagtgactgggcctgcagcaccttcagttcctgctggacatcctctgtgtgttcatatctgtgaagaaggatgccagctcttcctgcagatcattccatcatcaaagttgaaagctgggtatggtgagagactgatgtatgtttcagctgtccttataggttccagcctgtccattctgtccttgtttccctgacttcacatctgtcttttcttctctactgctttacatgtgggcttcaggctctagcaccaagacacagaagcagtagcttcatatagactgtttatccagcacccacaattgcgtaacatccaatccttggaataattctttactctttacagctcctatcaggtctgcttctcggatcaaactctgacaatgagcaatcctaggaaatcattcctctcctcacgtaactgtttcttaatcaataattagtccctctggctctatggtgaaaatgaagcatgacacagaattgtgctaagggttttttctttctgttcagataattcacaaaataggcaatttgcattttaataatcataagctaaattaacaggtgatgctgttgtgaaggtaagaatcactattgggaattatatcttggacttcatgatgtgagcaacattttaaggaagtcctcaagccctgggccactgatgtgacgaagcctgtgatgaagatgaaggttgagagcaagacctatggtttctgaatatcctggtttcatgcaggtgtagtgaaagcaataaatccacacatgagtttaacaccttgtttctttcaagtgctttcacagatagtggccacacttgtcaaaatgcttgccttataaacttgctgtgagaaacacattgataatggatctggagacctcaagatgaagctaggcacacagtcatgaattaatggtaattactatgctttacttttgtatgtctctttgactttcgctagctctcttcagtggatcttcagagtaatcttgaaatgctgttaacacccacttaagaggaaataagcacagagtataaaaatggcttgcttgaaggtcatatggctggcaagtggtacaacaaggaccaataatcaaattcactgaaataatgatagagctgataagtatggaacatataagcatgtgtcagatattgcctatgcatatcagttcatttaatcctcacaaataaacctatgagggtaataatagtatcccttttttatagattagggaactgaggttcaaatattaagagaggttaagttatctctatgttgtatcaagttaaacggtaatgaggattaaaatctcgactacagatgatcaagtggctggggggtgggggtgggtatagtgttctaagcctcagcttattaacaatgaaacagtacagtacttatctcaaactgttattctgaggactaaccaagctaagataagtaagctgctgataccatgcctgacatgtactgagcactctttttgttgttaattgtctcactagggcttagtctacgaagacctggtgcctttattgcttaaccagggattagttcactatggtccatgggtcaaatccagcctgaggcctgtttctgtgtggcctatgaggtaagaatgtttttaaattttcaaaggattgtaaaaaacaaagcagaatatgcaacagaggcctgtgtggcttgcaaaccctaaaatcttcactatctggtcttttatagaaaaagtttgccaaaccatagactatccatgctgttttttcaaccttgtgatgcagaactaaaagagacagaaagcctatattgatttagtctaaaaatgcagagctcaacttagagatcttggaagatagaggagtgaatgaaagaagtagaagaaaactgtgtttggtgtttttcagtgaagtgaataagactacatgagatagtagatattctctgccgttgctgttgcacctttctgtaagcaattaaagtataagtaactatagggaagttttttttttaataggggatattgctccctgtcatgccacgtaatctcttaccatttttaggagacattctagtaaagattattataaatttttgaaagtggatttgtgttttctttagggtgctgcactgtatagaaataggccatgaggcagcccaactttattagggttagatatgtatcttctcaaaactatcctgcctgaagcagattttaagtttctaccattcacatctttctatgataaaaatgggtgtttgggagacagcatttatcttcatgaaaaatacacataataatgttacagcgaagtcattgtgctggagagctcagggcagccttccatttggctgaccctgaaggcaacagttaccctgaggttcaaggctactagcctcctttctaggtcaaaaataaggaggggcaagaagcacttaagacagataacctgatagccactctgagatttatcctggttttaacaaaaatatgttaggaagagagtaaagagcccacacatattaaagcaaacaagtgcttccaagactcccatgaaactttaattaatggcacatgtatacatatgtaacaaacctgtacattgtgcacatgtaccctataacttaaagtataatttaaaaaaaagaaaagttataaatgaaaaaaaaaataaaaaacatgaatctcctggaaatgtttcttggttggcccactgcagaggtaaggtgtgtgagaaagacaagcagtgatctgtatcagggagagaggggaggccagagggcatgtgagccaagcctacaaattcatacagggccataaaaagtgcaggtgactctgggactacatacaggaggtgctactgcaaagaagtgaccagcctggggtcatcgaacagagaatgtagaggaggcaagatggataattatggagtcaaagaaaaaaagtccaatgtctaaaccaatggtgagacttcagggggttctttaaatggatgcctgcacaaaaataaataatgagcatgcactatatctacacttatttatggattattttcaatgaataattttattttattcttaaaattcatgtagggagaaggaatcaagttctccatttcagaaattagaaaagtttcaaaaagggaaaggaagtatatccattaagctcctctgatggacattcagggactccgtagacatttccacattccctcatataagcatcgcaagaagccagtttgcttattaccatgtatttaggtgttattgttgtcttttaacatatgaaaaagttgtgactgagaagtttagtcgagatcccacacaattagcaagctctaaagttggaatttgagccctatgtctggctataaccttgacctctttccattatacaatccttccttctctatgtaggattatcctaccttcagaaataaggagacaaaggtttgcacaggaatgaggtttgctgtctccaagtctcttgttctttctagagatcaagctgcttccacttttttcctcaggttatacgatgggcctgtcaacagattgatctccttattgatccctgaatatagtcccattaacctgtggaccactgtacatgttgctccccttgccacagataacctgacctgttatttacatttttcaagtcaaacttgagcatcagctcctcctggaagtcttccctcacccctttttcactgtgacaaccatcatggctccccacggatgccctccagtttataaagatgcctgtcctgtgggttcccataataccttatcatctccctacaagcaaataccacagtacattgtaagagccagattgcatatgtatttcttttattttaccatatattctttgaaggcaggggctgtgctcactgtttccccgggctccagcatggtccctgactactggtggtaagttagtatctgttaaaagaatgagtagatgaaagctttgtttacctttttaataatttttaggctacaattttgaatagtagatcaaagaaatacaaacaggaatgttcattattttattatttatccaatgatactggagtaggagaagcttcagacagagggatttgatatggaacttgcaactcaggtaggaaacaaaagttcacacaaaagggaaatggatacacttagttgcaatgactttaaggaaaaggcagagaaagagacctcccacctgtcctgttgacttttatcagcttttactttgttttgatactgagctaatcaaattagtatctatttccacttctatgtgcaaaaaagcttatttctaagggattaaaacatttcctaaaaatattcagaatagatacttatagtaaaaactaaaacaaaaaaaaaaaaacccttaacacaacacataataagtatctgtctcttatgaggacaaccaccaaaaataacatgcacatcccaaagggctgcttcctcgttacattaatacatcaaaatatctacttatgatgattgatttgtagatgttgatgctgaaaacccatttatcatttgcactgcaatttgcccatctttacagatcataaaaattcattgaattatgcttcttcttatactataatttaatatcttgttttcagcaccagaataaatccccataagtaataatttccctatgttaccctttagcagtcagtcccaatcaatgcattttatatacacacatgcatatgaaaagttaatgaaacaagtttctcacttcataatttcttaactggaacccaaaccaaaagacacagagagaagtacctacctatttaggaatcagaacaacaaaattacccagttaataagaaagtcagctgcatatttctaaaataagtataacatcttgctcattccaccaaaactgtaatttataaccaacactgtggaaaagacacatgtatgtattttcttagaagttcacagtagagatttttagtacagccattctacgccttagacactaacaagacaattaataaaatgatgtaacactggagatctggaataaatgtatgacttttgcattattagtacacatgacattatcttaccttattttcacatcatttctacaaaatgctctaagtattttaataattaatatgtactttttcaatcttttagagaaagtgaggcatggagaagttcagataatgcctcaaaaatatgaatgagatagtgaaaacgcaaaatgaaaataagataacagaccaatcccatcctctaatgcaaaactctctatttttattgtaaaattatgaaaatccccaattatttttagcctctgaagaaatttgctaattgttctcagacatccaaagctaggtcaagaacaagactctttttccccctcaagtcataaacttgtctaaaataaagtaaaacaaagacttaagaaataagaccctcaagtactaaagtgcttttgaacttcaatcgtatattagcaagttattctgaagtatataaccaagatcctggatctccaaaaatctcaagttgtgaatacctctatagcacatcatttctcccataaaatgtaggaaaatacaaaataataattcagtgaaccctttaggaccttaatgattctacaaatacattaataaaatcatttaaaaatctataaaaataaattctgcttcccaaataaacacaacaccccattatgcttccacattactgttgtgacattattgtgaagttactggaatctttaaagaaacttttaatctccattaattattgatctctaaacaatgaataatggatgacttccaaagcttattgagatgaagaaggtgggcagtccacctgggctactccctggccaaagagattggccagatcacactgtgtgtttccagtctatgcctcagtggtattatactcatcacacaatatgactctttagggtactttgtcaataggaaacaccatgagtgttgcatactgcctggaagagctccctttaactggtttggagaacagctgtcaaagccatttcatggattgacaattctttaccagactttcatggtccaggggagctattggggttttgtctgctatgttgatgtaatgataaacttttcaaaaagatccttttacatcctcacaaattctgtttcagagaactttctctaaaatgtattgatctcttggctctattgacttataataattagtcatatgataaacaaccagcggctggagaatggtgggccataaaccagatttgctttcaacatctggtcatggaaggagaagagtgacacttgaagaggtaagaaaggtgagggtgagctgacttaaaggttcaaagcaaaaagatgaaaaaaagactgcctttatgtataaaaatttccatcacacagagagcgtcctttgttcttaggggtgatgccatattgcaacttttatcccatgtaattggtaaggtaatgagatggccaaagagagatgatgctgaaggcacatactataaaatcgctgatgaacagagaccacagattttggtctctgtctctgtacaaggaagtagcacctgatattatttctattgactgctccagtattacactagcagttcctacagaaggaagtatgaactcatgatgggcagattactctattctgtccctttgttcccaactagctatactgaaaaaagaaaatggggtagaaaattataaaatatttaaataaaattggggctaaatatggggctaaaattataaaatatcacaataaaaatttcataaaatttggaatattaaaatgctaatgccatgtgcttctactcagatttagcaaatgttaacacttaccattctttcaacaaatctctctttgtgagaaaaaggcaaatgtagtggaagatcaattttcatcacttttaagcatttttttccctctttccctagaggtaatcaaggtcccaaagctgttttatatcctttctgattgttgtttgtatatttttatcacctatctgcatctccacataacacatagcatttgagttttaaaaagttttacataaatgtaatcatatagtatttatgctgcaatttgctttttcacacaagattggttgagatttttcagtgttgataaggaaaaatctagctcattcaagttcaataatatattcctgtataaatacatcttctaaaaaatgtcattgtgattcttggaccctcttggaattttaattagaatattactaagttgattaatctgagattaatgtcttcattatattaactttagccagtcgtgcacattgtgattctttctctttcatccaatcttttagatccttgaattgcacgttataattttttgattgttgttaaagccattttacacatattatgtacatagttagaggttccttgtagtcattattatcaatggaaatttttttcctattatattctctattttgttatggctgatatgtaaaaacactctcaagtttttatattgatctgatgtgcaataaaccttttaaacacccttctaacagtttggctggaaattcattttcaaatatctatataatcatatcatattcaaatagtgacaattttttttcttcttttccaatcaacctatagtttatattcttctcttttctttccagtaacaaatttaagtgctagcagtagccttgaatatcttatatcttactaaatacctgtctttaatggaaaaatttcttacatttcatccataagtaaggtgtttgctagaatgttggtggatactcttcaatagattaagagtatttgatccttaggtcgataagaatttttattatgaataatgctaaaatttagaaatattttttcctacttctattgaagtgattgtgtgattgttttctttaatcaatgtacagaattatactgagagatttttatgaatttttatgatagtggcctatggtcatattcctggaagaaaaagacttaaaaaatagttcaatgtatttataatactctgttggatttaatttgctgatgttttatttacaattttgtatatatgatcacacatgagaatagcttatacttttttttcctcttctgtttttatctcctcttgatgttaagactatattagcctcataaaatgaattgggtagcattctttatttttctattctctgaaacagtttggactatatatgtaccatcacttactcataaatccatttatacctatagttttctaagaaagacattttataatagctactggttcgttttggtttcaaactaagttttcaagcaactttaataatttaatttattaagaaaactatccatctcttaatattttaaatatttggtgtaataaaatgactgatcaaaatagtaccatagttttatctttccactgtatctacagttgcattattttttcattactcattcagtctctcttttttcttaatcagtcttgctaatttattctttaatacaatcagttttatttttcaaagggccagttttacttgtattgatcatctcttctttgttttctatttcattattgcttctttccagaggattcctttgcaaacaaagttctaaaccatttgaggaaaactattacaaagaaagtcgataaaatcaacaattaagatttgactatactccaaatagaataaagatcatagaggaaactgaaagtaaattttaagtgagatggttcagaatacatgcctagataaaaacataagaactatttttattgagaagataacgtattagacaacaatcactagggaatggggtgcgtaaagtatttaatgtataattgtcttttggagggaacagcataggaaaactaaataatttacatattggttaagtatgttaatttaatggagtactctgctagagcttttctaatttcaattttttgtttttttctattactgctatgtgtttgaatcagaagaagggcaatgtcatcttgacaacttacatattgtaagttatagatcctccagtatctttcttttacttaggaaactttgaaagataacctcagtctcaagtgtcatgtagatcttagatacataaagttctttgaacttgctcaattaaaaaaatggaactgaaacatgaatgtattgggcttcctatccaagcttattttttgatcctgcttttgaatacctttccctctttccaaacagaagagctgatgctgctcttgagggcttggcatttttctgcctttctttgtttaaggtttcacctttccctcagttcctcacctaaatactagaccatgagcttctagaggataggaagtgcttcttatctttttgactttggtgcctagtacattgcctggcacagagtactgaagagttatttctctaatagttacaagtgcttccttttgccatttatcttagtctatctcatctctatagatatgaacatagcccttaaagacactacaagtctaaatctcactccttcaagagtcagcctccctctattgtaaagcttttctttatagtgacaactggaaataattcaattttgaaagtttttttttaacgtgtctcttttatgccacttattgttttctataccataagacagtgatttatggacatagattttcttttttacaggactgtaaaccctctaagaccaggatccatctaatttttgttctatacaaagcaaaacaatttataaatatttgatgaataaatactttataacataaaggaaatgatcatgtttgaatttttcacttgtttgccttttaattaatcattattttcaccaggccagtaagaagattgctgaactatggtgctgatgtgtcacctggagagcagatgtcctatgggcatgaaatgttgccttacttccttttaacaagaatcaacccctcaacgttggctttgtagcaaggctacataaaattaccaggcttttagaatacctctaaagcaaaggtcaattataatttgttggataatttctcttctaaatttataattctgagatgtttaattttagagtgataaaaattatgattcaaaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctatatatccaacaaaggacgagtatccaaaatctaaaaagaactcaaatcagcaagaaaaaataaagcaatcctatcaaaaagtgggctaaggacatgaatagactattctcaaaatcagatatataaatggccaagaagcatatggaaaaatgctccacatcactaaatatcagggaaatacaaatcaaaaccacaatgcaataccaccccactcctgctagaatggccataataaaaaaattaaaaaataatagatgttggcatggatgctgtgaaaagggaacacttttacaccgttggtgggaatgtaaacttgtacaaccactatggaaaacagtgtggcgattacttaaagaactaaaagtagatctactgtttaatccatcaatcccacttctcggtatctacctagaggaaaagagttattatagaaaaaagatacttgtgcacacatgtttacagcagcacaatttgcaattgcaaaaatatggaactaacccaaatgcccatcaatcaatgagtggataaagaaaatgtgctgtgtgtgtgtatgtgtatgtacatacacatacaccatggaatactactcagccataaaaaggaattaaataatggcattcacagcaacctggatggaagtggagattatcaatctaaggggagtaacctaggaaaggaaaaccaaacatagtatgttctcactcatttgtgagaactaacctatgaggacacaaaggcatagaagatacattggactttggggactgggggaaaatgtgggggatggtgagggataaaagactgcacattgggtacagtttacactacttgggtgatgggtacaccaaaatcccagaaatcaccactaaataacttaaagaatgcctgggattttttatattttgttcaacatgaacttattaatattatttatattagaaaaatgcatgttagtgctgtttcagttagactcagaaaagctgatgtaatccaatcaaaaacttaaatccattctatcagtagatgtatcattaaggtttaaattcaatgagcagggaatgaagtcaagtttcagcaaatttactgtagaaaatgatgataagaagtgtgcaaagtggaatgctacaaacacacaagcagttggcgggggcgggggagggggcacagagacgggatcctgtcctgagtcagctaattaccaacctggggaagttacttagcccttctgagccttactttctatgcctaaaaactgggaattgtattgtggatttgaagaatgtttgttaagaatactgaaatgtatgtacatatgctcctaataccatatttggagcctatcatttatgttataatttatgatcctttatcataatcatttattattatgaggatgatgatgaaaattttccatagtcagcaatcctgggcttcatagccctatgatcagacttgcaaattagaacttgagtttctgctgcgatcaggtaaatgaagtttgtcctgagggtcatgatcatgacagtatgctctggtgcaaataattagggcaatttaaaaaattacattctcaatggtttgggcattaatcttttctaaataatcataataaagtggaatagtccatcttaagaagaagttatagccaaataattttgttcaattatattaaccaatatataaaacatgagatgctttattaaagcaaatgagaaaaaaaatctactttgccaaaagaacatttggatttttttctttactatataccaatgctctgtaacatgggagagctatttcctactttataatgaaaatgtatgtgaaatacacatgcaagacaaggacggcatgtatgataagtgatatgacccaggaagaactacaggagatcatgatacaaacaagggtctatgaactggtggggaagagagagtcataaagaagacagggaccagaaatacatgctaatggagaaatgacttcagcatcatagaagaaataagtaaaaactcagaaatgagaattgtttttcccaggtaactagtctcaagggtatggtggtgaacacagttgtgttttaatgcaatccacagaaaaaatggcagaatagtctgtgaagccaaacagcagtgaaggtgagtgcaaatctgggatgaataagggagggattagccaaggagaccttccacctgggaccccaatatgccatgaactgagctggttatggtagcttgccatttattaggtttaatattaatactaagcaatttactacaatgtctcataatctttacaatgattttgtaatgattatcttgatattacagatgaagaaactgaggggaaaaagatgttaacttttgctgattctttcaaaatctctaattcttacaacaaccttagttcagcattattaaccttattttcaggtaagaaactgaaatttggagacactgagtcacttaacaatggccacacagctgataggtaggagaatcaaagaatgaatatggatctgtgagaaaacacagaatcacatacatgcatctatgaggacttgaggtaacacactgtctcctattatttgaaatggtagaagctgagtctaggtcacatggttatggaatatctattatatgcaaaggtcaaagtttatagaattttagaggtgaaagggcccttagatatcttttattgcaatatgcttactttatacataaggaaatactccaagaaatgtaaatggttcaaagttaaactatgttcagtacgttcagtgattattaatataaagaatggaatcatacacacagaagattctgccccacctacatgggtaattttgtgatgccaaatttaacattttctaattaattgtctacaatttttcaatatcaaataattctctttgtaaaagtagaaaactggagaatgataagtttgaacataaaaaaggaaatggaaatgtgttaattataaaaaaaaaaatgtcctattttaaagttaggtggctgttagcattttttttctgctcaggcttgaccctgagagggcttcctctgctgtagatagggagttaggaaaactattcctatctaaaaatgaaaataccaatgtagcttacttgctggccaaggtgtacatatagacatcaatgtcatgtaacaaattttaacttaaatcctgcaatgagtataagaaaatcctaaattgataaagcaaccattctctgggaaccaggaaaagcaaaaacaaaattgctctatagaaatacttttacaaccatcctcacaaggaacttccacagaaaaagagatatccattgaataacagattcctaaccaaaattagaaacaacaggaggaaataaatcaatgtaggagtagtcagaagctaaaattaaattgataatgtatgctgtaagaatcaaaaataatatatactcttgaaaaagacaacatatttataataaaaatgtaacagaagagatagaaatcacaatcataatgaaagaacaagacctcctatgggaaaaagaaaaatcagatttaaaaagaaaccagaatagactgataaaaatgaaaattataagaataaaattaaaatgcagtgggtgtattaaacaacagctatgattagctaaagagggcattagggaattggaaaacagatgtgaagaagccacatagaattcaacacacagaaacatatagaaaaatttaaaagatgaagagatatggaacatagaaagaaatagattaccatccaagaaacaacttgttagagtatatacttgtggcttgttagtcttcccttatgtcttcgatgatggtatttaattgacttcctgttttgtttttgtgatgtctgagttacttacatattcagaagtagattacagtcatcccacattatccacaggggactggtttcagaaccccactctgataccaaaatctgtagttgctcaagtcctttatataaaataacgtagtatagttgaccctccatagccatagtttccccattcatggagcgcttactgtgctacactgatccaattttgattctgttaattcgtgtaagcatagtacaagtttaactatttattaagtgaatataaatagaactctaggaaactagaggaagcaaagataaatcatgacaaacaaaaatatgatagaaagtggtggaagtatgaccaaatataccagtaatcaggatgaaaattggaattaaacttccatattaaaaataatatcaggtaccatttaaaaataaccttataatgaaaaattataaattcatatgaatttatgaatgaaaaattataaattcttatgaaagaggaaagcaccaagacaagtgtagaaatataaggaatgatgactaatcatgccagctgacatcaggacccatacaagtataagttatagacaactagaccagtggcagaagggaaagcctagaatcacatgcattatgtgcaaagttggaatacgaagaacgtggcattaaaattaatatggacttaagaataggctatttaacaaattttggtaattcaactggctgtgggaaataattggatccctacttcatattaatacaattcaagaatttcatacagataaaataccaaaatgtgaaaagaaaagttataaaatttagagagaagtataatatttttataatcttagcacagaggaggattaaggaaataaggtacaaaatctatcagctatcatggaaaagttagttaagtagataaatgtgacatattaacattttaaatcgtctgtataagcaaagttaaatgcctgagactgggagaagatatttgctgggcacataagtgatataatattagtatccagaactctgtcactttgataaaaaaataggcaaataatataaactaaaaactcacagtagaagatacccaagcaagtaactagatgctcattttcacttgtgattcagagaaatgcgtatttgaaaaacaaagatatctattcacatcagcaaaatcttgcaattaattgggcaaatatgtcaaagaagaaaatggatgaataattgtggtacatttatacaatataatccttaagatcaaataaataaactatacctacatatatgaacatgaatatatttcaaaatataattaaaaaagcagtttgcaaaggacacatatagtatgtgcaataattatgaacacatgtatgtaccaagagtaaaaggtgatgtactaacgtcagtgtagtgatcccttctagtgaccaagaaaacacagaacacaaaaaacaaacaacaaactggaatgaagaagtatatagacgtataatgacactttttctaagaacaaaacctctgagacaatacttgattattttttgttgctgccatttgtctttggaactgacatcatgccggggttgggtcatgaagctgatgacttgatgtaagttgcatggatgttgttagtttcctcttcaattgccttttagctccttaaaagcaaatggaatttgtccccaatagtatattttcaatgactgatacaatttataaaatgtgagttgtcaacaaggagcatgatgaggagaacactgaaaatatgaacaaatcctaagaaagttaatagctagatcttgaatgaacttgagaggaagttatccaaattgaaaactaaggcttaaggaggaaggcaattgccagaggccaagtgactgatgagaagtaaggatttacaagccacaggtctccagctatttcttctaagcctgtggtacataaagttctttgtgtcagagacttccttgagagtctgaaggaagcttaaagtctcaatttcaccatttcttcaagaaatgagcacatatttgcaaaatttgcatataatttctgaagcctaaggtctgaaaccttacctaagaacatccactgttaagaatttctgtggacaagtcctaggctacatgttgttggcataggatctaattgggaatgctgctttttatttaaacaaatcagatattctttcaggtcaaccacgttggatgtggggaggatcatttttagaatgggagctcctcagagatggtagtttccaggtgagtggaagtagacatcagagttccaggtgagtagaggtagacattggagtctacttctgctcaccttggagtagacattggagaagggtgggatggatggaaaaggagaatcctttgggagaggcattggagtttgctgccatagcttgatctaagagctttgacaggctggggctttcagacaccaggattcaaagcagctcagagcatctccatgcaaagcatccagagtgctttgtagccatcctttcccataatacaggcaatctttctgttcttaattgcacaatttgtcctaagaaattagaagaaacaaagaaaagccttacaactacatgagagagattaactttttaaggaaggaccacacccaccatttcattaactctatatttccagtgcattgcagattgctgggaatttcaatcaccactcggtaaatgtattcattgcattgattgcaaaaagctaatttgatttgctttggatgtttctcctcctccaaatctcatgttgaaatgtgacctccaatgttggggtctagtgggaggtgtttgagtcatgggggtggatcctcataaatgtcttggtactgtcctcaaggtaatgagtgagttctcactctgagtgcatgtgagacctgactgtttaaaagaccctggggccagatgtggtggctcaaacttgtaatctcagaactttgagaggctgaggtggatagatcactttaggtcagaggttcaagactagcctggctaacatagtgaaaccctgtctctactaaaaatacaaaaattatccaagtgtggtggcacatgcctgtaatcccagctactcaggaggctgaggtgggagacttgcttgaaaccagtaggtggaggttgcagtgagccgatactgtgccactgccctccagcctaggtgatagaatgaggctccatctcaaaataaataaattaattaaaataaaataacctggcactttcttccttgctctcttgctccctttctcaccatttgaccagcttctcctttgtcttccaacatgattggaagattcttgaggctctcgctagaagcagatgctggtgagatgctttctgtacattccgcagaactgtgagcaaaataaacctcttttctttataaattacccaatttcaaatattcctttatagccatgcaaagcagactaccacagaaaattcatactgtggtatggagcactgctataaagatacctgaaaatgtggaagcagctttgggacttggtaactgacaaatgttggaagagtttgaatgtctcagaggaaggcaggaagaaagatgaaggaaagtttggaaattcctagagacttgttaagtggttgtgaccaaaatgctgatagaaacattggcagtgaaggccaggctaattaagtctcatatgaaaatgaggaagttattgggatctggaataaagtttacccatgttgtgtgctagcaaataacttagctgcactgtgtccatgtcctagggatccgtggaagtttgaacttaagagggatgacttagggtatctggtagaagaaaatttctaagcagtagtattgaagatgtggcatggctgcttctaacagcctacagttaattagacgcacatgcaaaggcataacttaaagtttgaatttacaataaaaaggactgcagggtgtaaaaatctggaaaatttacagcctggccacatagtagagaaggaaagaccattttcaggagaatagaccaagcaggctgtggagcaaccacttgctagagacattcacatgactaaatggtagtcatgcactcgtagccaagacaacgggataaagacctcaaaggcatttcacaagtttctgaggcaggtctcccaccacaggcccagaggcttggaaaggaagaatggtttcatgagccagaactggggcattgctccccacttcctggctgcggctcaaggcatcccaggtacaactccagccagatgcttcagatagcacaagttgtaagccttttcagcttccacatagtgcaaagcctttaggccctcagaacccaagagtgaaggaggcttggcagcttccacccagatttcagaggatgtatgggaaagcctgggtactcagacagaagcctgcttcagaggaagagccctcagaaagagcctttgctagggcagtatagaggggaagtgtggggttggagcccccatacaaagtccccaccagcacactgcctagtggagctgtaggaagggtcatgctgcccttcagaccaaataatggtagagccactgacagcttatgccctcagtctgaaaaagccacaggcaatagactccaacctgtgagagcagccgtgggggctgtaccctgcaaagccatagggacaggccagcccaaagtcttaggaggccatccctcatacccatgttcccaggatgcaagaagcagagccaaaggagattatggtggagatttaagatttaatgtctgctctgctgtgtttcagacttgcatggggcttgttactcctctcttttggccaatttatcccttttgaaatagaaatgtttactcaatgcctgtaccaccattatatctaggaaataaataacttatttttgatttgacaatctcgtaggtagaagaagcttgccttgagtgtcagatgagactttagacttttgagtgatgctggaatgagttaagattttggaggactattgggaaaggatgattgtattttggaatgtgagatgaacatgaaatttggaggaccagggaagaagtaatatggtatggatattttgccatttccaaatctcatgttcaaatgtgacttccagtattacaggtggacctagtgggaggtgtttgggtcacgggggtagatccctcatgaatggcttggtgctgtccccatgataatgagtgagttctcactctatgagttcacatgatatctggttgtttaaaagagaccgacactccttcctctatctcttgcttgctctctcaccatgtgacatgcttgctcccactttccttccaccatgattggaagcttctgggggccatcaccacaaggagattctaatgccatgcttcctgtacacccagcagagctatgagacaaataaacctcttttctttataaattacaaaattccaggtgttcctttatagcagcacaaaacagacacacataattctaggttctttttacaaacaccaagattcagacattttagtggtttaaaattagggtaaagagtctcattgccattattctctttaatgaacaaaacgttagttgtgaaattatatattttaatgaaatatagtgtagccatttacattaatttgtacattgtaaacatgttaatgtttctctgtattgtctcttccaccaaaaatgttatctttgactgattcaccctctccgaatactgggagagaagggttattttggtttggttttaatttgtcaatcccacaagcagttttcagcagatagaaggtatttggagattttcttacatgaaacaatccaagcatacactttataattttttttactatgtttaaattgatgtatacaacacatgcagaaaagtacacagatgataagtatataatctgattcatttctacaaagtaaatacatctatgtgtttgccaccaaaaatctaggtcctacactaaaaaatagaacattaccagcatcccagaagccccagatcaaagtaggcatatgcaagaaatattttgtaatttccaatgtaattgcttctttgatccatgggttatttagaaatacgttgcctaattttccaacatttgggaatacatttgggaatttcctagttacattcctgttatttacttacagtgtaatatcactgtgaagagatatatatacatatatatatgtatatgtatatatacaatctgctttgtgttttctggattaaaaaaagtttgttatatcagttgttgagaattgttacagtctcctactataattatagattgctctattcttcacttagttttgtcaatttttgctttactgaaattaagtctatgatttaaggtgaatacaaatttagaactgttatatctttttagtggattgacccttttatcattataaaatatcctgtttaccgctggtaatattttttgccttaaatctacattacctcatattaaacaatttggatgatatattttcagatatttttggcatttcctgaacaatgcaagcttcttagaagcttcaaatccaatgataccctctccatattttatatcattgttttgggggggtggtattttaattctgcataaattttaaactcaaaacaatattagtagcatcatattttaatatcactttatagggtcaatattaatttatatgtctactttttcctcattactttctgaattttcttgcttcaatctaggatcatttttctttgcctaaagaattcacttgtattttgttttctgcaaatccgtcattttttgtctaaaaatgtctttattttgtctttacactgaaaggataattttacttggtatagaatttcaaaattgctgtaatttgctttaattcttaaaaaatgtcactccatttattctgccttccataacttttattcaacttctattttagattcagggggtacataagtaggtttgttacatggatatattgcatgatgctgatgtttggggcatgattgattccatcacccaggtagtaaacatagtacccaataaatagtttttcaacccttgccccatccttctttaccccctccagtgtccctagttctattgttgccatctttatgcccatgtgtacctaatgtttagctaccatgtatgtgtacatgtagtatttgggtttctgcttttgtgttagtttgcttagtataatggcctccagcatcactcattgttgctgcaaaagacaggattttgttctttttttattggtgtagagttttacatggtttgtatgtaccacattttatttatccagtctaccattgatgggtatcgaggttgattccatataacaaacctactcatgtaccccctgaatctaaaataaaagttgaataaaagttatggaaggcagaataaatggaatggcattttttaagaattaaagcgaatcacagaaattttgaaattctacaccaatcatgggcattgaggttgattccatgtctttgccattttgaataccactccaatgaacatctgagtataggtttctttttgggaaaaatgatttattttcctttggagatatacccagcaatgggattgcttggttgaatagtagttccatctttagtcctttgagaaatcttcaaactgctttccacagtagttgaactaatttatattcccaccaacagtgtataagcattctcttatctctgcagccttgccaatatctgttatttttctttttttaatagccattctgacttgagatgatatctcattgtaactttgatttgcatttctctgataattagtaatgttgtatgtcttcttttcagaactgaacaaaataaagatctatacaggaaaaccaaagtttattttttgtaaggataaaaaagatcaatagactactagctagattaacaaaggaaaaaagggagaagattcaaataagcactatcagaaacaacaaagatgacattacaaccaatcccacagaaacacaaaagttactcagagattattatgaacacctctatgcacacaaacagaaaatctagagaaaatggataaattcccaggaatgcacaaccttcaaatattcaatcaggaagaaatagaaaccctgaacagaacaataacatgtgccagaattgaatcagtcattttaaaagactaccaaccaaaaaaggcccaggaccaggtggattcacagccaaattctaccagacatatgaagaagagctggtaccaatccttactgaaactattctagaaaataaaggaggaggactgcttctcagccctttggctaagatcaagtgaaaatcaaggaggagagactcctccctaattcatttgatgaaatcagcatcagctcaacattaaagcccagcaaagacatgataaaaaaagaaaactacaaactactatccctgaagaacacagatatgaaaatcctcaacaaatactagcaagctgaaatccagcatcacatcaaagtgttaattcaccacaatcaagcaggtgttattcctgggatgcaaggttggttcaacatccataaatcagtaaatgtgattcacgacatgaacagaattaaaaacataaatcatatgatcatcttgatagacacagaaagatttcagtaaaatccaacatcccttcatgataaaaaccctcaacaaagtaggcattgaaggaatgtatctcaaaattattggcaccatctgtgacaaacccacagccaacaccataatgagtgggtgaaagctagaacaattcccctattctccttaataactagaacaagacaaggatgccattctaaccactcctattctactgagtactagaactcctagccagacaaatcaggcaagagaaagaaataaaatgcatccaaataggaaaaaaagtcaaattatctttctttgctgatgacatgattttatatctagacaaccctaaagactccatttaaaggctcctaaaactgataaacaacttcaataaagtttcaagatacaaaataaaagtacaaaaatcagtactatttctatacactgataatattcaacctgagagccaaattaagaacaaaatcctatttacaatagcaacaacaacaaaaaaatacctaggaatacatctagccaagggggtgaaaattttctgcaaggagaactaccaaacactgctgaaagaaatcaaagatgacacaaacaaatggagaaacattccatgctcatatattggaagaatcaatatcattaaaatgaatatactgcccaaagcaatctacagatttgatgttattccttgcaaactgccaatgtcttttttcacagaattggaaatatcaatcctaaaattcatatggaacttgaaaagagcccaaatggctaaacgatcctaagcaaaaataaaagtcagacttcatcacattacccaacttcaaactatataacaaggctacagtaaccaaaacagcaatggtaccagtataaaaacaggctcatacaccaatggaacaaaatagagagcccagaaataaacccatatccctacaaccaatcaaccaaccaactgatctttgacaaagtcaacaaaaataagcaatgaggaaaggactttctattcaataaatggtgctgggataactggctgtgcatatgcagaatgaaactaaacctctatctttcactgtaaacaaaaataaactcaagatggattaaagatttaaatgtaagacctaaaactataaaaatcctagaagaaaacctaagaaataccctaatggacatggccttagcaaagaattttgactaagtcctcaagaacaattgcaacaaaaaaacctccaacatttacaaatgggatgtgattcaactaatgagtttctgcacagcaaaagaaactgtcaacaaagtaaacagacagcttacagaatggcaaaaaaaaaaacttgcaaagtatgcatgcaacaaaggcctactatccagaatgtagacagaacttaaacaatccaacaagcaaaaaaaatgaccccattaaaaagtgggcaacagacataatttgtgttgaatgaagtctgcattttatgtctttttctttaaaggttaaatgtctcttttttcttctgtctatatttaaaatttttacttttatcttttaacagttttactatgttttacctatgtgtagttttattttattttattcttgttggggtttgtcaagtttattgtttctgtgggttagtgtttatcagttttagaaaattctcaaccattatctcagcgaacatgactcctaccttattctgcacttcccttctatctgggctcttggctgcttagggcttcataacctcagttactctaaaatcccttctgggatatttttaaatcattttatgcacattatctggttctctgcaaaaggatcaatctgatctaagctaatcctccatagccagaaggagaacatccccgtttgaggtgatacttcttatactgtcataatcctagccatagactgaacacataatatacttatttttacttagacatagtcacatatgtgaaatgtgagccaaatttaagttatgtaaaaagataataatgttgagcctattaagtaacattaagatctgcagtcctagtcaccagttgccctaagtgagagtactagggcaatgtgacctcactataaacccgtgcatgcttgaggggctgccaaatcacaagctggagtcagtggggggtgggagggggtaaagctactgccagaaatcccaagccaaagggaagcagaggaagggagccaggtgaaggaagtagcagcgtggcatattgtgtattggaagatatccagaagcactttggggccctcacaggctacttcctcatccacagatgatacccaggcctccctctaaaagcagataactttttgtgtctaagcttcagatttcttaaaatgataatcatgaataattatattacaggctggtaatgactgtaaataataaatatgcaaagtgcttagaatagtgtcttattcagggtaattgcttaataagtcagctatgataatggtgatagtgataataattattgtgtttaagatattgatgattgtgatgatggtcataaagtaaaaatgattatcattaccatgaagaaagaggatatcatatatatagtatatgtatatatacactcccccaaaaagtcagctatgacatgacagaatgctagacttccccttttaccttgaccttaatatacagtaagtatgtatgcttgaaccatcccaaaaccttccctcccaacccctggtccatggaaaaaaatgtcttaaatatacatacatactgtatattaaggtcaaggtaaaaagggaagtctgatatttactgcttttaaatatgttttctactgtaaagtggtcatgcttctgagcctctatctgattgaactggctgagttctatatcagggcaccagtgccctaaacagggtctctgtgacataggacatgcctccacctgggttctactccactttccctcatacaagtaatgtcaaggagagaataaagctaacttattgtcatagagcttgaagaaggacttcacactagtttttatagctcagagtttcaggatgattaataagcaaggactccaaggagaaacagcacatacttcagaagagacacattcctcattgtggctcttgctggaaaatattgataatagaaagcaattttcccaaggttcattcacataggactagatggattttttgcttcaagttcactgcatttttagaagggaataattaaaaaaaaatctaagtgccacttaaaccaaatgggtaaagcacctagatagaaaatgataaaatcaggacactgccatttctattcatgaatgccttttctgtcttcatttaacttaagatatttttgattgtagagaagtaaaacatgcataaaataccagccttttcagcaagtgataggcaactttgttgatacaaatggatttgatgattacttttcaagctgtagataaagacagaattgatggtgacagggaagagatggaacccatatgggaaaggctgaggaaataaacttgtccaggatgtatttctatgcttttttatgtacaaagaaatatacaaacatagaaatatatatatacacatagtatatatgtataatgtgtatattacatataaatatatatatctgtgtgtacacatacatgtacacacagaaggaaaatatcttttaaattgagagaagaataacagttttcccctaatctggctgaggttaagattctagcaaatatgggctcccattcataagtaaacttgtcccagtgaagacagaggaaattgtctaagaaagccaaagggtcttccactgaggtggaacagagtgacatgggttaggggccccatgcagctgaggattcttcatcaaagtgagttgtgcaataaatgtgcactagagtaaaattacgtaagcctcaaagtctcctctgaaccaccactgtctttccagacttgaggaatctcactttcctctctcatacaactcccatggttctctactcaatagcatctactatgtccctttttttctagtttaatcctcccagagacctagagttttcaaagacagaggcagatgatgggagaaaacgtcctagagcagcggttcccaactgtattggtctgttctcatgctgctaacaaagacatacccaggactgggtaatttataaaggaaagaggtttcattgagtcatagtttagcatggctggggaggcctcagaaaactaacaatcatggcagaaggggaagcaaacagatccttcttcatgtggtagcaacaaggagaagtgccaaacaagagggggaaaagccctttataaaaccctgagatttcaagagagctcactattatgagaacagcagcatgggggtaacgacccctatgattcaattacctctcatgggctccttcccacaacatatggggattatgggaactacaattcaataggagatttgggcggggacacagccaaaccatatcatcaacatttctggcacgaggaaccagttttgtggaagacaatatttctgtggacctggggtgggggttggggcaaaggtttcaggatgattcaagtgcatcacatttattgtgtgcttgatttctattattacattgtaatatttaaataattatacaacctcaccataatgtagaatcaatgggagtcctgagtttgttttcctggaactagatggtcccatctaggggcgatgggagatagtgacaggtcatcaggcattagattatcataaggagcatgcaacctagatccctcacatgtgcagttcacaatagggtttgacctcctgtgagaatctaatgcagctactgatcaagaagagccagagctcaggtggtaatgtgagtcatggggagtggctgtaaatgcagatgaagcttccctcactcacctgttgctgctcacttcctgctgtgcggcccagttcctaacaggcctctgactggtatgggggtagagggtgggggtgttggagacccctctcctagaggaaaggaaatgcaacagactggctttcttcttggaatcccctcatcagttctcagttttctcatctataataagaggagtttgaactataattatctgaagtctgccccagctggttactctgggagtctaggatctaaaattggggaaagacgacatgcacatagaaattacattttaaaaatctatatagtgtaggaaagaaggaagccctgaggctgaagcagtgactatgcaactctccttacagaagccatgttcaggagacctcattcccttttgcagaccctcattcacttttttcccctcacccctactcagaatcagagctaatttttcttaggaaagaaactctttccagaagtgaggcagatacaatgctttgcatttttcagatgagaaagctgtgagtcacagttgagtaatttgtccacagtgacacagtgtatctaataagtggtagagagaaacaagtaggagacagagacagtcatttgacagaatctcccttcccttgaacccttgtgtcaagagcttctgggatcctactttcaacactggtaggctggactgcttttggctgaggtgagttctctctaaagccatcttgctgaccatcactttatattggctgacctctcagtttcctctctgtaaatacaagcagcaatatctgagtccatgcctcccagggatagtaagataaatgagataataaaggtgagaaccaaatgagctcctcttaatgatggtgttaaaaaccccatgaggtactgtgatgttattaacaaaatgcagaggctgcagagttacatttggccaaattcttacacctctcaattttttagcaaggagacatagatatgaaatcagtattcccaatagtgaaactgactacaagtgtgttctcatttttaaacaaacctattctatgcaaatccaattaatagaaaaagtataccaatcaaggatctatacatatagctatctttcacaaaactattctagttttccttattaaaaaacttcaaaacacttcatgctttgtggcatttcagtgaaattggaattgtaaaataatgatttactgaaaaccttttaaaggtactgatctggcatgaagtgaggtacgactgaagtttctagacaaccatttgagattttggctgtggagccctcccaaaagaagattctaccagccagttgcatcacttgcaaatattggaggccgttgctctggaaaagcaactaaaaataatacctgggtgtggacaaaataagaagggagccatactcagctatgagccagtgtattgcaaagggccagtgctggtcaaaagcagtggggccatcatcttgatttagacatactgtccacttctctaatgcaaacccacaaaattgttgactcttagagtgcccacaaagcttctgctgtgacgataggacttttagggccatgaagaagctaacactaacttttacatttcaatttttaccttttcccacatagcttacgctaaaactcttcccaacttgtggcctggagaatgtatttttctggcattacattccctttccaacattattcctgtccctcaacctgttcagtaatcttatctaaaactactggataattcctttgagggtgctatcatagcccaaatatgtcaaggtctgtttttcactagtaaacagtgaacatcttcagttttaaatgataagttaattctacaacttaattgagcccatttatgtttattcattgctgaagttcctcttagatcttgccttctctcacatcttctctataacccaagaaggaacccacctagatctcctggaccccctcttgcctgatttaggtagatcatcataggagatgaaaaattatcatctcaaatttaagttttcaagagatggtatcaaaacacgcttttgtcaacaagcccaatcatattcccacaacttttgagtgctcttcctgattctagagcaaacacactgatttagatagagcaccatgtttctgaaccttgaataatcctgttcagattgaagcaggggtgtattaatagagcgcaggtcttggagttaaaccacacccgccctcacccccaaccccaccaccccacaacaggcttaggaaggttgctcaacctctcaaggcgaaggcgtttgctgtttctcatctgtaaaacaccaaagattgccatccccatcactgttgtggaagatcagcgagacataaagtgcctgtcaggatgtttggccaatagtggtacctgattcagtcattcagtgactttcacagtcaccttgagcttgactctctcaagaaaagaaaagaaattaagaagcatgtgagccattgaaccttgaccacaaatattctaagaaacttataactccttagccatatgtttcatttcaaatccaagtatgaaaaaagctatgtaactgaactaaaaagtggatctactctataatttattgtattataatacatatgtatacatctcacacactgtgtatttatactttaagagagaaagacttttataagactttttacgtcaagtgagggcatctgttcatttctgtagagcacatactgctttgctgcagagtgcagagagaatgactttgctcttcataccctaaaattgagtccaccagggatgaaacataggcgtgtagtagcaaaggcttctgtccagctgagcagtaaatcctggctgcccctgatgatcacagggactggctcctggtaataattttgatgtcattatcctctcctagaaatgcatgaatggttctggcctttaaaaacagatttaagaggatgcatttatcttgaccttatcagccttttaaagatcatgccgtagggcctgttgacctttctctcttaacgatgagttgcaaaacagtgggataacatcaatggatgaaagggagaaagagtgtgtaaccagaagcagcacccatggagaggaggaggtgggacagggatgttcaggctgacaaaggaaacttgctttagtcctgtgggaattgaagaatcccacataaatggaagcacaggaggcacaaatgggattccatttccatctctgctctaaatatgcagtccttgggtactgtgatggttaattttaggtttcaacttcactggaataagcaatacctagaaacttggtaaagcattatttttaggtgtctgtgaggggtttttccaaggagattagcatgtgggtctgagtaaaataggtggggaagatctgcctttgatatgaggaggcaccattcattcttccaagtccagaaaaggcaaatgtgtcaatctatctgctgaaactgggatacactcttcctctcttgttcttggacaaaaacttcaggctcccagcctttgggctccagaatttatagcagcaacccctttccccacctgaggctctcaggtctttggtcatggaatggggattgtcataagcttccttagatctaaggccttcagtcttggactgagccacactactggcatcccagggtatccagcttgaggatatcatgggacttctcagccttgataattacatgagccaatgcttttaataaatctcttctcatttatccatacatattttattgattctgcctctctggagaaccctaatagaggtatacatcaaggcataagtcaagaaaaataagatatttggcttattaagtggttggcaatgacttcaactcttttttttttttttgagatggagtctcactctcgtgcaggctggagtgcagtggcatgatctcagctcactgctacctccgcctcctgggttcaagcaattctcatgcctcagcctcccaagtagctgagactacaggcatgcaccaccatgcctggcgaatttttgtatttttagtagagatggggttttgcattgttagccaggctggtcttaaactcctgacctcaagtgatccacccacctcggcctcccaaagtgctgggattacaggtgtgagccactgtgcctggctgtgactccaactctccaacgggtaaagcacaaacacatttacttaactgcacccaatcttgtgaattttgacacttttaaattataggtagtgttcaccaattcaccactgtataataggaataacatgggattctgtgactgttcatgtaaaggattcatataaagctctatcattttctagtagagtttcccaaaatattttttaaaaatatcaagggtttctaacatctcaaggattaaagacaataataagtaaagagttcttcacacagttctttggtgatgccatgtgtttaattaatgctaatatcttctcccattccgccaaatttccctttgcaataagttgctcaatcgataaatcaaatgatgaaaaaaagatacagttgataaaaattagaaattgagaatgtctggcttccctgaaagttttgagatctagttaccgtgaccacatatttagggcaatacagaattttaacagagggaccaaaatttgaaattgaaagcactctgaaaaaatacaagagctgccatgagcacagtaaagatctctaatacacacaaataaaaatcgagtaagttaaaagcaccggcttttctgccctctcaacccaaggaggtcatatcaatgcacaaactaaaatgcacaattctatgcttacccactatcactacagcccagtgaatgctttaaatcccagacatggttaaaaatatagctggttatgtgattttctattaaacctaatatagtgggatgaaccataataccttacaggagcagatgaactagtatttccaaggcaaccaaaggatatcaatatcactttattattattattattattttcattctgcaaggaatcttccttgaagagcaattccttttatgcattggtctgcttgatagctttctgaataactgtaatccataaggctttgtacctctttttgcatgctggaaacactctgacttaatctaattatctcatgaaacttcactcttaaataaagcttgaagtaaaattagaaagcagcctctttcttttcctttagttactgtcttcatggtaccttcctcttggccggttgctcataagaaaatgggctatgcctctgcagagaaagcattctttacacttctctctggcaaggagaagttgggtttgggccaagtcgggccccatgaaaagagaataaaatatgactggaaaccttccttctgcatgacaaaggagtggctggctagaagcaaacatttattgagcaaatattggaagtcaggcacgttgaaaatatcactggtctaagagatctcagatttgccagggagaaaaatgggccaacatgggatgtcaatatactccaataaagcctataagggtcagcattgattcattatccaaacagtgtgacatttgagaatgaaaggggagcatcaaaaattctgcaaggacaactgacataaacattatcctaattaggatctaaatgtcttgaaacacaaaggagaaccctaattgaagtatacgtcaaggcatgagtcaagagaactaagatttttggcttactaagtggttggcaatgactccaactacaacatggatttggaggaaggtgggccaccagaggtttcagagaaatttttgcgttgggtcatgaaggaaaaatagatgttgttaagtggagaatcagaagaatgtttcatacaaaatgaaagagcaaggacaaagatatagagtagtaaaattggatactgtggctcataccaatttgaacccagagaaaacaattagaagatttcatttttccccttcatattgaaaaaatacaaaagactgacaatgccaagtactcataaaggcataggttaatactccatgtataggtagaactaatttggagaatatcaccgaagtgtctaataaaattgaagatgcatatgccctataatccggaagtcaaattcctgatataaacccacatgtgtatccaagaataaaaaagaacattcattgcatattgtttatcatagcgaaaaattagaaataagttttcatgaagtgcagaatggaaaaataaattgtagtaaatccatttaatagggtactattcagcagttaaatgaactaaaacccaatggatctatcaaaataaataagtctcaacaaacatattaagtggaaaaagaaaacaagctacagaaagatatgttctataagataccataacaataaagattaacagcatggaaatagtactacaaactgtttaatgtatacattaaaaggcttgcatggctactgtacataatgctgcaatgaacatgcaagtgaaaatatctcttttgatcaattatatacaatagggtttgcactcctaagagattattcagcttttaaaaagaagaaaatcctgccatttgccacaacatgaatgatcctagaagacattatgctaagtgaaacaagccagatacaaaaatacaaatattgcgtgatatcacttatatgtgaaatctaaactagtcaaactcatagaagcagagtgaaatggtggttgacaaaaattcaggaaggggtaagtgaggaggtattagtcaagggtacaaagcactttatccgcacttggaatatacaagtcctagaaatctacagtacaggatagtgcctatagttaacagtattgtattgtatacttaaatatttgctaagatggtagatcttatgtaaaattttcttatcacacacaaaatagtagaaataataaagagagcagaaagaaacttctggaggtgataggtttatggcatagattgtggtgatggtttcatgagtgtgtatttatctctaaactcatgaagttgtatatattaaatatgtacagcctatgtcaattatatctcaaagttttttaaagcttgtgtgagaatgcaaatatagagtcttggacagtggtttgatctaggtagaaaagtaaagaagagaatcaattaagatgtacatagttgcctttaactgtgattgtatctttatttcttaaaagagaagagggaaatgtgacacaaattggcaggtttttagatctgatagagctgggggatggttacataggagtcccctctattttatggggagattagtagggatctgaagccaagctgtctgagtccaatccagtccagctcaaccacttcaccagtgcgtgacaccttgggagaatgattttacctctccaagtgtcaactcctttcctataagatatggctaataacagtgctacaatgactaaatgagttagtgtttgaaagctcttagagactacaggaataaataagtgatggtgaaataaaaataaacaatgtattgcacagctcaagtaggtagaggacaggagagctgggatgggtgatgataaccttacttcaatctcatttttcatgacaaggaaactaaggttaggggagtagaattaactttgattacaaggtagaagcaatcagagatatcacactgggctcacaacaaaagaactgtataactggaaggctccttggtgatcctactgatagggacaggaggcagagaaattctagccagaaaagggtgagtctctggtgaagccccaccttcaagctgaaaagcctgaaacaacagcccaaagtgagaaattctatcgctgtttttccacttgaatgtttccttttcataaaccacccatggccccaccatgcctcatcctgtgcctataaagaccccagagtcagccagcagagaggaggagcagctggatgtcagagagcagcagcttgacttcagagggatggcttgatggagtaacttcagagaataatctggccagagatggctagacttcaagggaagattacctaccctctcatccgtccccttttcagctccccttcccagtgagacccactttcattggcaataaaatctcctgcatttaccattcttcaatttgtgtgacctcacttttcctggatgctgtacaagagcccaagagccatgagtgtagatacaaaaagctgtcacactggccctttgcccttgctggcagagggcagctgcctcacacaaaaaaacaaaagactcactgagctgttaacatttaagccatccacagatggcagtgctaaaagagcactgtaacacatcatctggggcttcaggggtcacaggcacccctacctggatgctgccgtggggcccacatggagttcactcctgctggtgccgatgtgtctagtcagttccaacactcatgcactccagttcctgcctcgttcgctcatgcactctctcccatgaggagttgagggcggtgggctatgtaaatgaggcattcctgttgtgagtcccatgaaggggtcagggaagtatcctgcttcactagcatttagtacagaagttgacaaaacttttccatagaaaaacaggccttgggtaggatttggctcatggactctcaggctgtagttggccaacaccttgtctaggggttctcaaatattctatgcatcagaatcacctggagagctagttaaacacagattggtgggccccacccccagattttctgattcggtaggggtggggcctgagaatttgcatttcccacgagttcccagaggatgttgatgctgctgggccaggggccacatgtgggggtgtccaccgttataatgtaactttctcattttatacttgaatagaatgaggccaaactggatcaatgaatagaattgatccaattttgttaagtgagatcagacagcaagtaaaagaatttaggcttcattcgaaatcttgtttattttaaaataacatataaagttacaactgtatcctgggtgctgtgctaggctctgggtatataaagataaatgtgacatggtccttgccttccagaagcttgcagtatagtagaagaaatgagataatagatgatacagtatgtaagactcctgggagcataggaaacattgggaccccagagaattacctggtttcttgaaggaggggccacctggagtatcttgaagaataaatagtcatccaacaggaaaaataggcaggtgaggggaggaaattccaggtaaagggaacagattgtgtaaggcataagagaagcaacatggcatcatgcttcacagtaggaattctggctctgctacttactagcctgggtcagttatttaacctgaaaacctcagtgtcttcttccaaacatagggataataaaagaactgaccacctagggttgatgtgtgaattacataagataatgaatgtatagtgttttggcctagtgcctgaaacacaattagtccttaataaatatgggcaattgttatttgtgttattattatagccagtgatgtatcagagcatgatacattcacagtcattaatgaactaaagtatgaggtgcaggtggagctactgaggcgggcaaggccagaaaatgaaggactctagtccctgcctgactcagggagggcagtgagcagagagtggcagaagagtggcattctaaggtctccattataattgaaggaggagagaatgattaagacaagtgatgtggtaaccaagaattgggaaaagattttgaagaaaagatgatgaggtcaattttggaaatcagtgggatatcgaaatggaaatgtctggaactcaaaagaaagatcttggctacccaaattcgaaatccctgggttggcagttgaatagatggaagtgaaatatcaccctgcaatattatgtagggagaagagagttcacaccaatgcttaaaaagtcagcattgagaagtagaaaagaagtagaaaagaagaatcatgagacagcatccaagtagctaagagagaataattttaaggaggagttgcagtcaacaatatagaatactccagagatcaagcaagataaagatcagtgagtaacacctggatttagaaccaggagaggcaacttagacctctgctttatactaggtggaatgcattgtgtacatttcataaagaaatatatatttgcatataaggtaaaaggggataagcagaaattaagtcaaagagcaatttttctccccataatgaacaaaataccctcctcctaaaaacctcaagaataaagatttgaaagctttactctcaccctctccccaaggacattccaagccctctgtgatccccagatgacactagaccagcctcaactcctctgacatttttatgaagattgtcttaactatgcagagtctgtattttcccaatacacaccgtgacttttctagcctctgtgcctttggtcatcctgctccctcagtgaagaattcccttaacttttcctaaaataaggaaataattctctcataccttaaagcttgattcttgttccataccagaccctcattatcttgcccacctactactatcctctggcccaaaactctttatagcattttttttttcacaacctacactccttttatttacctcctcaattcctcaaggtgaaaaactactccctctctgttggtgtgtattctatccaattgtttcgttgtatccaagtgcctggtatacagaaggcagtcaataaacagtattgaaaggatggaggaaacaggtatcatgcttaaaatgcatttctaaataattcaggacaagcaaaagaaaattaattaagaagttatgcacataaactgaacaactgagtgggatacagagaactgaagtttacagagaggatgtgggagaggggacggcttacgaagaagaggaaagtaaccaggtatctactaggcacacttgtcaaaagtaattttatcgtcacataaactttaaaatactgttatcgttcccatttcaagaatgagtgcacagaagcttggagaggctaccaatttttgcccaaatagagcagcttatgtcagtacaaaattgaatatgattcttacaatacttcaggattctgataccatgttgctttttggaattagaatacagaagactaaactgaattaaacactaaagcaagatgtaaatagagacttggcatccattaactgatctagtaaatggcatctgtactgctgaggcaataacagatacgtgtataaaaaatggatttataaaggagagaaatcagatctgtctcatctacttgcctcatacaattgtgatgagaagcaagtaagacaatgtattttgcaggcattttgcaaaactggaacaactctctgtatctaagagacaataagttataggactcctgacttcctccctgctctacactctttaaacatttctcttgccaattttttgcttatcctttcctttttgccttaatcatcaaaacatgattgcaattaagacttggtgtttctctgggtcctgtttcgaattattttaataacatggtatatttcaagaagtatttcaaatagtgtcatagaaattttgactaggggtcagaaggcctgttatttctcttggcctcactttctttacctgtaaagtgagagaacggaattaaatgatttctaaaatttttcccaactcatgcattttataattatttactcttctgaaattcctgtgataagggaagtgtagattaattctcccccatcttgacaatttggttcttaggaatctgagaatatctttattttcttgttcttgatatgattccaagaaagcaaatacgtattagacaaatttctctctgagtattattattgtagcactgaaatccaggatgagtaactttttcctctaaatattagattaagttcctattctcactgttgacagggattaaaaaaatacttccattccacacagcaccttttgtcagctagaagctgatagaaaatttcaggggagaagtgatcatcttaaacagcaggccctggctttaattcagggaatgaaagttacattgattttttttaaagtgatctgaaaccagcaggaatctctatccaaagcccagacagatggctgaaccaatgggctccctgtgatcatctctgctacccatatatcatttgggtagaaaataaatgggttttaaattacctttagttccagatagacctagaaattaaatctctacacatttgaaaaaagctaataccaccttaagctgcattaatagaaatcaatttctttgtcatgggaagtaattgactcattcaccctatatttaagttagaatattcatttcttttaatcatatgctaagtgtaaaagtaacacattagagtttgtccaaagaataatgggtagtacattaagagggtctgaaagtcatgttctctataagacaacagaggattgtaattcagataaaagacgatttaagagagacctcataatggtcgtcaattattaatatataatacagtacattctatgttattcaggaggacatagcagataaacaggaggaagagatatttgattaaatggtacagagaagattccaaaggatcaagcaatcctgagttagaacaggtcttctcagaaggtgacactgactagacacacaatgtgtgaaggagtgggcaaatggctatcagttggagatgatatagctgggaagtaacaaatattctttataaaattaagatcccctttttcctttcttttttttcttttttttttttttggagtcattctcaagtcactttcaaaatcaataacagaaaaaccaccatctcccctggaggaaagacatgggctctcatcttcatctgtaaacatggaaccctgatatcaggttccataaatatctgctctatttatgagtgctcatgtttgttttccactagtggtatcatttttattacaggtattaggaccctcatatccttttctatgatagcaatttgctctctgtttttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaaaaaatgtcttgtttagagttcaccctatctgcaaaagtcttaactttggagtcagtcacttaacattcttggttttagtatatatttcaggaaaagatgtaataaatcactccaagatacaaatgcatctgggaagcagaatcattccactggaaagcaagacaaagggggcagtgctctgcaggtactaatcagatagaaagaagcagctgagagcgatttcttgcatctgtttatcaagtacataaatactttaagcacctactgttagccaggcaccgtgcaggcagtatagcgggtggaaagatacaaattacttgccctctaggacttgacagtctgtacacacaaattcctataatgtgatgtctatcgtaaagagtacaaagaaagtttaagaattcagaattgaatttgatcattttcagctgaaacatcaaggagccatgaaagggggtaatctaaagctggcttgtgtggaatgagtcagatttcaacaggcaggtataggagccctcagggtggggtagagtaggaaaataatctgaatatgctgagaggcatgacaaagctgctgagctgagaatgctgaggacatacccagggaagagttaattagtccaggttgacagcagtagctacatgctggggaattgtgactgatgagcttagaagttgaggccaaattgcagatggctttggctaccaggagagatgtgtagacattaccctacaagaaatgggaggtcattgaaggttttcgatcaagggtataataggatgctgttgtgctttgattagtcttgttgcaatgactaaaaaatgattgaagaaaataaaaacaaggtaggggtttatcacaatattctgaaagcctgaaaccacaatggtagcagaaggcataaaataaaatgacatatataagaattattttgtagttaaaagctatgagtttgagcaatattgactttaagtggtgggcgttaggaagaatcaagatccagaaggctaaacaggagcagaagtactttcattgccatctcacatattcacttatgattgcgagagtctcactgaatccaggtgtgaccacaggatgctcagaatagtaccatggcagagtactcagaatgtgaattctgcagctggactgcctgggtttgagtcctgattctgctacttactagctatgcggccttgagtaagttactaaaccagcacatgcctcctctcataaaatatggccaacaatcataataattcctttatgtgaaagttaggagaaataaacaagttaacatttgcaaagtgcttggagtcatgcctggcacaaagtaagtgttttacaagtgtttgttaaaacaaacaaaacctcactatgttcacatagtcctatattaatgtgagttgccattgtgggtgaaacttttggcatctctgcccatctcctaaagcgttgtcttttctttgttcttaatcttttgtttgaaagctatattttctctttagccaatttcattcactcagtggctataaatatcatttgtatgttggcaggagacaaatgtgtatgtcccctcagacttctcctgccaacaagatgccttcttttgaaagtttcacaagtgcatcaaaattagcatgactaaaacagaatacatttatgtgctgcatatagatgtttcagtcagtggtggactgtatatacaaccataatcctataagattatactggaataccatatgttttactggcccttttctatgtttagatatatttggatacacaaatactcgccattatgccacagttgcctacagtattcaggacagcgatatattgtgtaggtttgtagcttagcagcaataggctataccacatagcctaggtgtacagtaggcaatgtcacataggtttgtgtaagtgcactctatggtgtgttcacatgacaatgaaatagtctagcacatttctcagaacatatccccactgataagtgacacatgactatttgaatctccccaccccaaacctgaatcacctatagtttaccaattcagacaatggcaccatcattcatggaggtgttgtaaatccaaacttaagattcatccttcgttgcttttttttcccccattcaatacatcagtatgttctgtagacattgtctccaaaacatttccagagtcagtcaatttatcgctctctttactcctgactctccaagtctagtcactgttatttctcaaaagcacttctgtaatcgacatctaagcagtttctctaattccatgcttgcccttttctagttgattctccccacaacggctaaacagattggtaaacaatgtatatcatgcatgccactactctggttaacactctataatcactcactactgaataaagaattaaacctcaatattctcaaatggcctacaaggcctcttcttcccagcttctcattctcttttcatgtccttcaatcccttccttggctttctctatcatcttccaacatgccaagctctttctcacttcaaggacttccaaggtttgtgctccaccttgttgcaactttctaaacttgctggtccactgaacaaattctacttaaccttcagggctcccttcaaatgacatcttcccagcaaggccccccaactcttatttccttcatagaatgtgcatactttgaaaatacgtatttattgtagacttgtttggttgatatttgcctcatctcctaaattataagctgagaggacaagaccatatttgttttgttcactgctatacacccagaccctgtttagtgcctgggttgaaatgtatgttttgacaagaaagaaaagaaaaaaaagggaaggaaggaaggaaggaaggaacgaaggaaggaaggaagggaaggaaaggaaggagggagggaggggaaaaatgaagaatggaggaaatgaagagtgggaagggaggaaggaaggaagaagaaaagaaaagaaaagaaaggaagaaatgagggagggatgaagagagagaagaaaagaaacaaaggaacaaaggcacgtaaaccctggaagacaacctaggcaataccattcaggacagacatgggcaaagatttcatgatgaagacaggaaaagcaattgtagcaaaaaccaaaattgacaaatgggatctaattaaactaaagaacttctgcacagcaaaagaaactatcaacagagaaaccagacaacctacagaatgggagaaaaattttgcaaactacacatcctacaaaggtctaatatccagcatttatagataacttaaattcacaagaaaaaaaaaaaactccatgaagaagcgggcaaaggacatgaacattttcgacagaagacatatatgcagccaacaagtctacaaaaaatagctcaacatcattgatcactaaagaaatgcaaatcaaaaccacaatgataccatctcacaccaatcagaatggctgttattaaaaagtcaaaatataacatatgctgacaaggttgtggagtgcctatacatggttgatgggagtgtaaattagttctaccattgtggaagacagtgtggcaattccacaaagatctaaagagagaaataccattcaactcagcagccccattactgagtatatacccaaaaggacataaatcattctattataaagacacatgcatacatatgttcactgtagaactagtcacaatagcaaagacacggaatcaacctaaatgcccatcaatgatagactggatgaagaaaatgtggtacatatacaccatggaatactaggcggccataaaaaagaacaagatcacgtcctttgcaaggacataaatggagctagtagccattatccttagcaaactaacacaggatcagaaaatcacatacttcatattctcacttataagtgggagctaaatgatgaaaacacagggacacatagagggtaacaatacatactggggcctttcagagggtggagggtgggggaagggaggagggatcaggaaaaataagtaatgggtactaggcttaatacccgggtgattaaataatctgaacaacaaccccccatgacataagtttacctaggtaacaaacaaacctgcacttgtacccctgaacttaaaaggcttttttttttaaaaaaaaaaaaaaaaagacaggcattcaccaaccctgatgagtagccattgacttttgcctctcagacctggcaaggcattgaaacaatggagttaagaaggataaaccagtttggtatgaaaagaggactcacttagttttggcttattatcattcagggcacacatatttactgtctcctccatgcatgcttcccacatgttattacagaaaagatattagaaaagaaatgaatacataacaacttcaataaatatgaacaagtggtacttgtaagaccaggaattttgaggagttttcagaagatatcaagtgaataggatcagatttaataaaataataaataaataactaggactgagaataagctccttgtagtataatagcttttcttcctaaattctcactggctccttagataaaggttaaacctgctgacaaaagtactcggagcagaagcagcttacatagggcaataactagagtacaacctatgaaagccttggctgcttttccttctcctcctttgcatattaatgctaagtttggatatggcatttgctcccatattgaaaccgtgtaaagggccttccagtaaagcaatacagtgtgtatgagtatgtgtgtgtgtgagagagagagtgtgtgtgagtgtgagtgatgtgtgtgtgtgtggtggcttcctactatgtgcctggggccagagagaagcagaccaaaccaaggtaacttcagaaccacacagctgacacagaaatgaaaaaataaggacaattctttagaggactaaaatgcaaccatacatatcacttcctaatgttttccttactttagaaatagatttcaccaacttgtctctttatcctctgctcctatatcttgaaggaagatggtgaaatcagcattgtctccatttctaaccctctcattaaaagtagggggctatcataggcacaggtgtaactgcagaggaaatcataccagcttccaataccaactgagctctttgtttaaaacaggaacaaatagataaacataaccagacatctgagggaaatcaatagcatgagagagaagaaccaagattaacaaagaaaggtaacataaaaaacaaaagaaaacttttaaaaagttcaatcagtatacttgcaagaatttagcaaactaatatgtctataaaataagaaaatactcaaacggataaatagaaaaaatgaaaagtttttggaaattaagatataattgtcaaaatttaagaaggtaacagaagtcctgtacaaaagaatggacattgctgaaagccaaagaagaaatatggaagataagaaaggaaatctaaaaattaacataaaaaggcagagatagaaattgagtgcacagaaaggatacatgttgcgggaagtcagggaccccgaatggagggaccagctgaagccatggcagaagaacataaattgtgaagatttcatggacatttattagttccccaaattaatacttttataatttctcatgcccatctttactgcaatctctgaacataaattgtgaagatttcatggacacttatcacttccccaatcaatacccttgtgatttcctatgcctgtctttaatctcttaatcccgtcagcttcataaactgaggaggatgtatgtcacctcaggaccctgtgatgattgcattaactgcacaaattgtttgtagagcatgtgtgtttgaacaatatgaaatctgggcacctcgaaaaaagaacaggataacagcaatgttcagggaacaagggagataaccttaaactctggctgcctgtgagccaggcggaacagagtcatatttctcttctttcaaaagcaaataggagaaatatcgctgaattctttttctcagcaaggaacatccctgagaaagagaatgtgtccctaaggggaggcctctgaaatggccactttggggacagctgtcttttacggtcgtacataagggatgaaataagccccagtctcctgtagcactcccaggcttattaggatgaggaaattcccgcctaataaattttggtaagactggttgtctgctttcaaactctgtctcctgataagatgttatcaatgacaatgcgtgcccgaaacttcattagcaattttaatttcgccctggtcctgtggtcctgtgatctcaccctgcctccatttaccttgtgatattttgttaccttgtaaaacatgtgatctctgtgacccataccctaattgtacactccctccccttttgaaaatcactaacaaaaacttgctggttttgcggcttggggggcatcacggaacctgccgacatgtgatgtctcccccagacacccagctttaaaatttctctcttttgtactctttcccttatttctcagactggccaacacttagggaaaatagaaaagaacttacgtgaaatatcgggggtgaatttcccccgatagatatggaaattataaatggaaagaaaaaaaggcattaaagacccatgtgttgcaaaaactatccagaatgagagagtaggggtaacagatgggagaagataatcaaagaaataatagaagaaaatttttctaggaagtgacttgaatattcatttagtcgataagatttactgagctcttactttttgccaggcattgttcttagcatttacagatcaggaaacaaaacaggaaaagaaatctctgcctcccacaaataattaacaaacatatacacttagatatatcccagtgacatttttgaacttcaggaataaagatgatatcctaaaaaagccagtaaggcctggtctggtagggaacatttatctacaaaagcattagacttatctgagactctttgcaagctggcaatagagtaacacctaggactatcttaaggaaagaaggtaattttgacactagaattttattaccagatgaactgtcagtaaagtgtgagggtgaagacaaaccttttattggacacctgaggactcagaaaactcatcactcatatatccttctggtgaaaaaaaaaaaaaaaacaaagcaaaacttaaatatggagtttccaaaactataaagtgaatttaaatatataccacaatatgtgagaaagaatagaaataatctaggcagtaaaacaaatttagtgtgatatctgaaaacaaggttagaaagccatcagttgatattagaacagcatgttggaggctccaagaatgtattcaagaaaaagtagttgtcataacaccaaattcctgattaaaaatcaagactgtaaatgtattgtgaaactgatatattattgtgtgatatattataaaaagtcctataataatatattactgataccgtttcagacagatgagatgaagggttattttctcccaattagccataaaaaggtaatattttcctagtaaaaataaatgcaagaatggcagtgtctgaatataaaactcttttaaatgaggcataattctgggcaactgatatagtgttagaaagatccttcaggggaaacccatcatatctctaagaataaggcagatagcctcaaataaagcataaaagtatttataattgatattagctacaccctgtgaatttcaggtgatcacatggggaggtaaagctgaccaaattcttggaatatgaggttgtaactgggaagtgactggaactagggtgggagattttgtagtagttcacataaagcaggtgaccactgatggaagctgtgagaagaggagatggcagatgaagaggctctggaagtctaccttttaggaggtgacatgaggaagagcaggcacagcgggctgcaaaggaaccctcaaatctataaatatgcactcttccagaaaggaagaggaggtgtccaaaatgagactcactggtgattggtgattggaaaggcgacaagggcatttggcaggaagtgatgacccaattctgttcagtgagggaagaaggcagcttgcagggcaatttggaattggaatgcaaaaatcataagtcaccatggcgtctattcataagaagtcatgaagcgggttggtggggagaaagaagccccctaacctcagccatgatcatcaaaacgggtccttcaactgaggctgggctgggaaagaggagctggcttgctagtgttgtgaaattttcaaagtaagagcatcccatgctggatacttgctgcataaaagcctttgctatatagtttatcttttttaagactgttatagaaactacattttataagtgtccacaggcatatccctgtcatgcttttgcagttataagaagtagaattcctggttgggagttatagtcttcctgtctttgattttcttctgcttgacaaaaaggaataacctgaggttaaagcatcctgctgtgtattctgtaaacaatcccattatcatacaaccacccagtgagcactacttacccttacaaagtatcaacagataactaaactgctcttcagtaaagctatatctgatttcaagtacaaataaaagctctaaatagtcacacagaatgatatagttgatgtaattcaagctctgttctttgtgtttacaatcatagtgctattgtttattttatatgaactgctgaaattcaggaatatgtggtacaacagcgattagagacacgacttggcctacagtagctccaccaatctggaaccctttgaaatgttctcttggaacaaaactcatgtagctgaatgcctctgtgttggaggctaactgaataattagagtttcccccatcaaattctatgtaaaatacagtgcatagtagagaatcagtaacaaaaacatgcaattgacccttgaacaacatggggtgtgagctacgtaggtcgacttatacacagattattttcaataagttacactgagggtgcctgcccatcctgcttccccatctatctacctcttctgcctctgccaccactgaaacagcataaccaacccttcctcttttccctcctcctcagcctactcaacatgaagacaaggatgaagatctttattatgatccacttccacataatgaacagtaaatctattttcttttccttatgactttcttaataacattttattttctctagctttgtttattgtaagaatacagtatttaataaatatataaaatacgtgttgatgaactatttgttatcagtaaggcttccggtcaaccataggctcttagtagttgagttttgggggagtcaaagttatacatggatttttggcggcatgggggtcagcatccctaatcaccacattgctcaagggtaaattgtattgttaaaactcaacagtaactacagcaattgtttagagcttagacccacaaaaggtttttcgaagtggagtattttatcactggcatttttacaatttccagcacctggggataataaaaagcaggtcatttggtgggtttcattattattattaaattctctccagacaatgcacgctgttactgcctgcacccagcatggaacactccctatgttccttcctttgtgcacttctgactgtgtagatcctgaagttccaaagtgtttctcaagaggttgattagctagaaccacttgtgttgattggccagaaatttcctggtgtgactaggaaagccatgaacctctgagaaggattggtacaaaagcctatccaacaggagtacttcatattggatggctgcaacgtgacccaaaccctctcagtgctgaaatatatatgcaggtttatatacacttacatgaggtagtgtctttaagtacaatacgctgtagttggcacatactgaaaagccttacacgtgcctccctggatcagatggaactcagaaggatcaggaactcagtaatggtacaattgatcaggttgcttttatacaactttaaatagcctaaagcaaaattataataataaaaatcgtaatatctttgtatactttcatagtctatgatgcaggactaactctaatacaaaattttatttttacaaaaatgtttgagacacatttctcattgtcttattgtctgtattttacaaatgagtaaactgaggctctgagacattaggtgattttcaaacattattgtccatcaaatggttggaacacaatggagtgggatccaaagcatgaccttctaagtccagtgggctttctgccgtgcagctctgaagtgtggtaataatagggactctcataaatgaaatgataaataggactgcttactggttacatgaagttttcaatctgttattaagtagcagttcagatttcactatgtttaatccaccagcaatgatcttttccatcttgcatacctggcagatgcctattcatcttttaagccctatgtcaagagaagccttcatctgcaaagccttttctgaccccaaaggtagggttagttgttttcttttttctgcagccaatccacatgtgtggatcccaccactcatgtctcacatgccttattaggctaaactgtaactcttaatttgcatgtctgtctctaaactcaactgcgagctcttaagatcaggagctgtcatttattctgatttgtatacctagtgtctagcagagtgtctggcacatcaggctctgagtaaattttacacactatgcatccccatttttggggaaaagaaataacaaagtatttctaattgagggtgagtcagtgtaacatcaccctctcatactgagagaatatatccattaaattctgcttgcttcctcttagagatgaaaaatcagaaatctagagagagagacttgcatcactgcctccacttacaaacactgatattgagaacataataaaattatcctgtggatgaaatcaatattctattccttaatgctgctaactataacttccaaaccaatcttagcaagctcacaaaaaaatatcagagctggaatggttctttggaaaccatgcagctcaataccctgattctataggtgaggaaaacaagctcctgatatgctaagtgacttgcctaagatctcatgtttggtcagtggaagacacaagccactgagcattttccagaacccgttgctgcatctattatccaaaggaggaagacaattgataacaaaaagtccgggggcacaaaatactggtgtgctcacccacacacacactccctgcccaagaaaattcaatggctgaattagaagatctatcaaatgtaaatgacaagttaacaggtgcagcccaccaacatggcacatgtatacatatgtatcaaaactgcacattgtgcacatgtaccctagaacttaaagtataataaaaaaaaaagtgctaaagaaaaaaaaaaaagaaaactcaatggctgaaatatgaccttacacagttaatgactgactacctccaatggagagagttattcaatatgccacagggctcattaaaatgcaagttttattcttaagataacttgaaacaaaattctactctcaaacacaaaggtttacatacaattttgtagcaaaacaattgatgtcataaagtaagacatcaggaggggctttggagtacagtccaattcgagaaatactacctgttaatgcaagtgatctggttctaggtccaactccatcattcatttgttctacaactaaagatcaatctctagccttgttgaatcttccacatttactgattggtgatagaaatacgtgtctttttataagttgtcacaaatgagacaaacacatgttgatatcacgtaccctctgataggatgtaatgcaaatggaactctatctccagggaacctttccccaaaactcacaatcccagattaaccaagaaaagcatcaaacacacagaaattcaggaattttatacaaagtagctcaccagtatttctcaaaactgtcagtcatgaaaaatcaaaagattcagaaactttcacagcccagaggagacgaaagagacatgaaggctaaatgtaatatggtatcctaaattggattatgcaacagaaacaggaccttagtggaaaaactcggatattaaaaaaaaatctggagtttagtttaccagtaatgtatccaggttggtttcttagttttgacaaatgtattgctaatgtaaggcattaaattagggaccttggataaagagtatatggaaactccctgtataacttttctgtaaatctaaagtcatcccaaaataaaaaaattattttgaaagatgacacctggaaaggctttctaaaatgtaataaatgatatccaaatgctagatcatgtctagagagaagatagatttgtgttgagttttcagtggattaatctggcatatagccttttatttttgcctgtagttcatttttttctagaagataagcagaacagtactattgtctatccaagaagtatcacctgttaatcaaatttatacatatttgtagtggaaagagcattggattagaaatgtgcttatttataaacctgcttctacgttgacctgcattggaaatttagatagtaactttatctaatttgctttgttttctcatctggaaaaaggggagtatgagtgcaaattttgtaagggatgaatgaagtaacatgagtaaaccagtactgacaactataaaatcatatgttcatgtgatgggttaattgtgcttccattagctttggagataatgtaagtatgaaaaaaagaataatggtcttcccaaaatgtccatattctaatccaccaaacctgtgaatgtgttaccttatatggcaaaatatattttgcagatatgattatgtcaaggatcttacgatggggagatcatcctagattatccagatgggccaaatgcaatcacaaacattctgaaaagtgggaggcagaagggtcagagttagagaaagatatgtgataacagaagcacaggctggagccatgcaaggaagggaccctgcactgagtaatgcaggtggcttctagaaggtggagaaggcaagggattgatttctcctcagagcctccataatgcaggctgccctagtgacaccttgattttagtgtgtccaacttttaaaatggtaagataataaatctgttgtttctagctactaactttagggtaatttgttataagactgatatggttagcctttgtatccccacccaaatctcatcttaaattgtaattaccaggtgttgagagacctagtgggaggtgattggatcatgggggcagtttccccacatgttgttctcatgatagtgagttctcatgaaatctcatggttttgtaagtgttcactggttcctctcttgctggcttcttctctctccttcctccatgtgaagaaggtgtttgcttcccattcaccttccgccatgattgtgagtttcttgaggcctccccaggcatgtggaactgtgagtcaattaaacctcctctgtttataaattacccagtcttgggtagtatccttatagcagtgtgaaaaaggactagcacatggagctataggaaactaatacaattactttaactatcacttaattgggatgtattgaaggataaacttactggcttatcaaagggagactgaatgtgggtctcttggaaggggtggtcacatactgaatttctgagggagaaaacctcataaattcactatatgccgcaaagcaaagctttcaagaagtggtgtggccacttttttttttttttttttttgagatggagtcatgctttgttgctcaggctggagtgcagtggcacaatcttggctcacagcaaccttcgcctcccaggttcaagtgattcttatgccccagcctcccaagtagctgggattacaggcacccaccaccatccctggctaaggtgtggctacttttaacagcttacagtaagatatggcagcaaaggaattacctaaaggtggaatttgtaattaaaaggaaagcagaatataaaaacatgaaaaatttacagtctagcaatgtgacaggaaaggaaagaatgttttcaggagaaaaatccagtggtgctgaggggtaaccacttgttaaagagattaaaatggataaaagggagtcaggtgcaaagagtcaaaaaaattggaaaaaggtttttcagaaatctttgtagccccctcccatcataggcccacaggcctgggaaaacaaaatggtttcagggaacaggcccgagttaccccgaagccactttgatatgctttctcaacattcaagctgctccagctccaggtgaggcacaaataaccccacatactatttcagctggtgctccagagggtgcaagccataaatctcagcagcatccacttggtgctaagtctgtaggctcctagaatgcaagagcagtggaagctgccaagcctgtagatttcagaggatgtattggaaagcctgggtgcccaggcagaagccttctgcagggaaggagctcctacagggagcctctactagggcagtgcccaggggagctgtgggaacaggagcaccacacttcagacaccagaattatatagccactggcaatgagccacactagcatggaaatgctgcaggtattagattccaaactgtaaaagcagcaatgtgggctgcacccagaaaaactgtgggggcagggctttccaaggacttgggagcccacttctcatatcagtatgcccaggatgcaggacatgggtcaaagaagattattttggagctttaagatttaatgtctgccctgctgggttttagacttccatgaagactgcttacccctttcttttggccaatttttgtctttgtgaacgagaatgtttacctaatgcctatacaaacattgcatattataagtagatgaattgcttttgatttcacaggctcataggtggaaggaacttgccttgagtctcagatgagattttggatttgggacttttgagtagatgctagaacaagttaagactttcgggaccattgggatagaatgattgtattttgcaatgtgagaaggatgtgaggcatggagagtcaagcgtggaatgctacagtttgaatatctgacccttcaaacctcatgttgaaatttgattcgcaatgttgcaggtggggtctaatgagaggtgtttgggtcatagaggcagatcccttatgaatggcttggtaccacctttatagtaatgagcaagttattgctctattggttcctgtaagagcttgttaaaaagaacctggcaatttctctgtatctcttgcttcctctctcaccatgtgatctttgtacatgctgcctccccttccacttgcactatgagtagaaacagcctgaggccctcaccagatgcagatgctggtgccatgcttcttgtacaccagcctgtagaatcatgagccaaatgaatctctttatctcaaaattctttatgaattatccagcctcaggtattcatttacggaaacacaaatggaataagacagcccccaacattcctacctcatagtgtacacaccctctagtatgagtgagatttctgagtataatggaatttcacttccttgagtagactgccatttctggcaaagatgaacagattttgcagatgtgaataacgttcttaatccgttgactttcagttaataaaaaggcatgttatactgaataggcttgacctttaaaagagagtctaggccttctcaggatagggagatttaaagtaagtaaggcactttcctgccaaccttgaagatgcaaactgtgttgtgaactgcttattcagcagtggcaggccataggagacaagggtctcagccctacaactgcatggaattgaattctgccaaggacccacatgagcttgacttcagatgagaatgcagccagaatgacacctttttcagccttatgggactcagtagaggatccatttaagccatgtccagacttctgacccaaggaaactgtgaaataacaaatgtgtgtcattttaaactactaaataaatggtaattcttaagtagcaaccaaaaaatcaaggcaggtaccacttactccatgaattaaggaatgaagagcatgcacagccccaggctggccatcctggatcagcaagtaaccctcaccaaccagccagatttctttcctgggagtactgtgaagaaagaagagcttacactccttacctgttaatcatgagactttttttttttttaaagtggacattttgataaacaattagacatcagtggtaacttgtaggtggttgggtataattaccttccttgtccaataatctttagattttaaaactacccaaaaagaaaaggatggaaaatagcaagctgggagggttattgacctgggtaaaccatttgtacccaattttaaagaatgcaacagatgatgctgtcctgagccaaagtagcctgctaggtccaatgctgatcagaaatggcagcaatgagttcctctattaatcattcagaggaattctgtattatgattttaagctgctgaataagtggtgatctaattcctcagaaattcctgcttcccagatctcagaggaagagtaaagtgcttaaaactatctattgtcctttatttccaggatctccatccaaatactttatgtggcccacaaggccctctatgagctggcccctgaccaccccaatctccaaccattttgcacttgtcactttgcactctggccacagtgacctttgttccatttctcatacatgtcatgcccacgcttgaggctcatgcttctgccttaaacagctggtctaagatgactctgcactagcaacgtccttccttagcttagcttctcctagattacacaaggaggctctccttgatctccagactatttctactaggctttttaaaaccttgagtactttccatttatagcatgtactacagattgtactgatgtgtttgttactattattattttataactcaatttaagggttgaggaacagcctttcactctgtctcccgagtcaagcctttgtctttttctttaaggaatattgctgtctattctgacccaagtttgtttggcaaacattgagcccctggtgcatggaaggcctgaggtatatcctcgaggaataggtggtgggaagagataaggtccctaactctagaagctgaaccatccctaggcccctcactgctcctatcttagctcatatggccctcttctctgactttgaattctgtaagagtttcaatctctcctttgattctttagggtaaaatccaaacttctagttcctttcaggtaaaatccaaactcccagttggtatggccctccataatcaggcccctgctgctctccaaggccttaattcccagagctcttcttgcactagtgaacattctcttccaagcttccaggcttttgcccattgatatggtttggctgtgcccccagccaaatctcatcttgaattgtagttcacataatccccatatgttgtaggagggacctggtgggacataattgaatcatgtggacagttactcccatgcagttctcttgacagtgagtgagttttcatcgcatccagttgttccttcactcagctcttctccttcctgctgccctgtgaaggtgacttgcttcctcttccaacacgattgtaagtttcatgaggcctccccagccatgctgaactatgagtcaattaaacttgatatctttataaattaaccagtctcaggcagttctttatagcagtatgaaaacggactaatagagtaaattggtatcacagagaatggggtgctgctctaaagatacccaaaatgtgaaagtgactttggaactgggtaacaggcagaggttggaatggtttggagggcttagaagaagacagaaagatgtgggaacttcctagagacttgttgaatggctttgatcaaaatactgatagtgatatggacaatgaaatacagcaggctaaggtggtctcagatggtgatacggtttggctgggtccccacccaaatctcaccttgaattgtaataatctccacatgtcaacggcagggccaggtggagataattgaatcatgggtgcagtttccaccatactgttcttgtagtgaatgagtctcatgagatctgatggttttatagacgggagttcctctgcacaagctcttttgcctgctgccatgtaagacatgactttgcttctccttcaccttcagccatgattatgagaccttctcagtcatgtggaactgtgagtcaattaaacctctttcctttataaattacccagtcttgggtatgtccttattagcagcatgagaacagattaacacagatgaagataaaaaaacttgttggaaacgggtataaaggtgactcttgctatgctttagcaaggagactggtggcattttgctccaccccagagatctgtggagctttgaacttaagagaaatgatgtagggtatctggcagaagaaatttctaagcagaaaaccattcaagatgtgacttgggtgctcttaaaagtattcaattttatacattcataaagagatggtttgatattggaacttatgtttaaaagggaagcagagcataaaagtttggaaagtttgcagcctgatgatgtgatagaaaagaaaaacccattttctgaggagaaattcaagctggctgcagagatttgcataaggagccaaattttaatagccaagacaatggggaaaatgtctccagggcatgtcaaaggtctttacagcagccctcccatcacatgcccagaggcctggaagagaaagtagtttcctgggctgggcccaaggcctagctgctttgtgcagtctctgggcttggtgccctgcattccagctgtggccaaaaagggccaacatatagctcatgctgttgcttcaaagggtgcaagccccaggccttggtggcttacatgtggtgttgggcctgtgggtgcacagaagccaagaactgaagtttaggaacctctgcccagattttggatgacgtagggaaacacctgaatgtccaggcagaagtttgctgcagtggggagccctcatggagaaactctgctagggcagtgtggaagggaaatgcggggtgcgaactcctacagagtccccactggggcactgcctagtggagctgtgagaaaaggaccaagatcctcctgaccccagaatggtagatccaccaatagcttgcaacatgcacctggcaaagctgtggacactcaatgccagcctgtgaaagcagctgggaggtggactgtaccttgcaaagccacaggggcagagctacccacctcttgcatcagcatgacctggatgtgatacacagagtcaaaggagatcattatggacctttaagatttcactgccttgctggattttggacttgcatggggcttgtagcccatttgttttggccagtttctcccatttggaatggctctatttacccaatgcctgtacctgcattgtatccaggaagtaactaagttgcttttgattttacaggctcataggcagaaggggctggccttgtcttagatgagactttggactgtggacttttgagttaatgctgaaatgagttaagactttgcaggacagttgggtaggcaggattggttttgaaatgtcagagacatgaggattgggagggacccaaagtggtacggtaggtttaggctttgtgtccccacctaaatctcattttgaattataatccccataatatccacatttcaaaggagagaccaggtgaagtaattggatcttggggtggtttctcccatgctgttctcatgatagtaagttcttacaaggtctgatggttttgtaaggggctcttcccccttcactcagcacttttccttcctgcagccttgtaaagaaggtatcttgctttccctttgccttctgccataattgtaagtttcctgaggcctcccggccatacttaactgtgagtcaattaaacctctttcctttataagttacccggtctcaggcagttctttaaagcagtatgaaaatggactaatacaatccctctttgcctgtgctgtcaagtattcctcacattaccacccttctccactttgagtactcctgaaccttgtcaagacccagttctaacttcctttcttcctttagccttgtagtgagatgcctggccctggaagactgctttaggctgcaagtgacagaaagtctgactcaaagtggctcaagcagtaagaagtttgttacgtcacttaacacaataagtggtgaggcagttccatggtgaattcaacccttaagtgagccatagaagatatgggtttttctcaactctccattttgccatcttagtgtgtcttttgtacccaagtttattcagaaggcttctccttacatggcatgaatagaactgtttatcacatatgcatgactatattaatgtattactctgggttctcctgagaaagagaatcaacagaatggggtgacagtgagagatttatttaagaaattggctcacatgatggctggcaaggatgatgtctacagcgtaagccgataggcaggaggcctagggaaatgttgatattgctgctcctggcctaaggcttctggaggcagaactccctttttctttggggacattggtctttttctcttaaggccttcaactcattggataaggcccacacatattatacagataatctgctttactcaaagtttactgatgcaaatgttaatctggtcttaaaaagtacctgcccaacaacatccaggcatgtttggtctaatatctgggtacgtacctagccaaatggacacatcaaattagccatcacaatgtctaaaccaattactgagaagaaagagaccagaatcaccattgttggtataaatctcagccaagagtaaccctctggggctggtaaggggctccttccctgagtatatgatggtatggagggcgaatgtgcaagcatagtcagggctctgcctgcaagacagactctagttgtgggtaaggtcagaggaaggcataggtttgagcaggtaaacaacatctgttaaacacttaggcaggcagaatcccaatactgtgttgcctcctttacatgtataaaccctgttggagcccttgttaccctgagtcatggatttatggcttatcttcctctttagactgtaggctcacctttgagtaagaatcatgtgtgagttacctgtttattaaccgcccaaacttggtgctcagcacaaggtaggtactccataaatgctattgaactgaccaaagtggggcatttgcgtgctgaattaaccttgtactcaccattgttatagagctcatatatttttatccaccacagctttgttgaagtcacagattcacaactgttatgccaactgactattatttctagacacttcagtgaggaacttatgggacgataaaactagttcagtcatatcaagttctctcctatttcacacatccataacctgaaaaaaatctcagtaacaaattgaagaacactcttaactttatagtcaagtaataagaggtaaggggtccattgtttgccacaagtacccactcagataaagtaggtcatctggagtcagatgttagagccccaggttcagttgcttaatccacaaattctcatgactcttatccttttcaacagagttggagttcccaaaagtttagaaagtggaatcatcagataccaatcttctctaccagaaagacaaaaggctttagacctgttaaattcagaggatgaggaagtcatcttttagttgtccactgtgtagaaacccttgaccttataaattcaagcatcccccatgtttcaggcatcttgagaaacccttacacacattattacactatccagtttgtaattgtctccctcaagcagataccaacaacaattgacatatactgactcaacatgcaccagacatgaacatacacacattacctccattatgcaatttaatcctcagcaaacctcacaaggctgatttagtccttatctccattttacagatgaagaacccagggagctgagctgggtaggtaacttgctgacagtcctaccaacaagaaaccacagaacccagactcaagtcccatcaactctgacttcagaggccatgatcacacttgcacacgttactgcttcccatgtagtaaggtttacatatattatctcaattaaatttgagagtgaggaaaagttattttatatcaacatgtaaggggacaataaaaattatttcctgtggttgtcttagaagcaacaaccaactcaaaatagggccttgaacactttaaagaaagaatgtgacaacagagaaaaaaacatcgaaaaatgtgaggcagacacacaacattttgcagtgaccacccagttctacccatgggcatgtcaatcactacagaggatgttctctttacaggttgtactaacttagcaagacttcttattacctggagagaataccctttatttctctaattccatactcaaaaggtacaagaatataattataaatgtaacttctgagatatcttgaatataacagatttcctaggaaaaaagtatgtaaacattctatttctttaaaagggacatcctcaattgtaagtattgaatgccatttgtcaatattgtttcacatgaacatagcttgtgccaatgaaattgttatatcattagaaacctggtcatttctagatgaattaatcaagttcggtttctatgttcactgggccatagaatagatgtgccatagtaaatttatgaagttaataatattcatttctgaggctatttggcagccagttggctttttcctgggtcacccactctcccttaccatgcctgctttcctccaactgcaaagcctcacgagtacttataattgccccatcatacaaatgagaaaaaatgatgctcagaggggttttgtgacttgcttagctctgcacagctggtgtaatagactctacagaaggacaggaaaagaagacatagaagccaagaatgaatgaggtgacctgggactctgctctttctatttgccaccaactacagagacctcaactgacatctccagccctctgctttcagtgccggagtagagattgcacactggctcctgctgagagctttatttcttattctcacatctgagcagttaaaaatactttgaaatatgtcacctgccttcccttctatccttgccttttgcttgctttttctcttgcctcgctttactaaagcagcaaaagcaagaggaccattaaaagcaagaggaccataatgagggtaagagtagtgggaggagacacagggaccctccaccttgcttctgaacgaaagtcataatataatccttgctttaatctgtattcagttctctgtcctctgcccgcatgctgacaagatccactttacctggtatttttagctgatacttggcgcgatgtgctaagtgctggccatggatgctgctaaagtgacagcatgtgttccagcagctccattgccatggtcagtcttttcatagttcctgtttcattaatgttaagaaatggctcttccttacttaaccaaatgtcagcagacacagcttcggcccttaatcatccatccccctgcccctgagggcatcctatagattgaaggacattgagactgcaggctcagatggaaaaaaaagtaatctaattgcctgttacttaacaaactttgtcttgatggagtattcattgcacacataaattagactgcctcaccttttgcaatgtaaaatcctggaaataatgctagccttcattctaattgtttttaataaataaattaaagaattaatgtgtacttacctggaacaaagcttccctggaccacctccttgtatgcccaccagccttcatggatttttggtgaattctgttgagctaaaggaaaagcaaagaagagagattaagatgatagcagagaagcactgtgtcccggctgtccgagtaagaagggtgaatatccataaaataacccttttctaccccaaagtcatactacaacagaaccttccttctcccttcccttttttttttcaaatagatcattgatcggtaaatataaaaacatttttattgaaagttctctgatattttaattgatgttaaagagatagtaattatgtatttaagtcccctgctacctgtcctcatcatcttccccatacacacacacacacacacacacacacacacacacacacaacacacacacagtgctcctgctgaaactgaggagacagtaggcagatcccatccatgtatgtccatggaacccttgttttgggagagattgaagtttgctgagggagccagtctggaaggctgaaaggtatacccagccagctttccttaggtcccaggaaaatgaaaacaagaatataaataactgtggtggaggtttttgacatcacaggcaaaaagggcagagggctcaagatattggaaaatatcgtggagatctgtaagctcatgctgacatgacctcagggaaacccttgaattcatgacagttgacaagtgaattggggcaatgccattacacatgcacacaaaccccaaagtatacatgatacataaatttatgcttatccctttattaaactacattcatatttcaattcccagacacattggaagaaaataagtgaatcaatcatatttgtaatttggctactattaatgttaaatcttaacttttttcttttcttctttaaatctggtgggggtttttttccagccttcctcttcaaagttctagggaaaagactcatcattctgagttagaaagaatgggtataagacaatgggtttgaatgcaaggctttgtatagagagaagatttactagatttctctagtttccagataagcttggactgtttagcttcaagtctcttcttatagtatagtgaagatactttttcttcctatgatattaagagccctgaggcttgtatctttgtggttgaaggagattttctgacataggatgagtgaaactgaagcccactccttctggaactgacagtgggcttaggggactttaaaaacaaataaaagagagacaaagagcttatttaagactctggaaaaaataacacctttaaatttgcccagcacaaatctcaggcatggacacacaaaagtatcctggatttcctggtattcttattgcccctgtggtgtggatagagttcagacatttccatagcccttgaggaagatcccgaggtcagctgagttggaagccaatgcatctgctctgggacagcaggcaaaggaggaagtcacctcaaagcagaagccagaaaggttctgtccaaccagggagtcaggcggaagattcaactgagactctgggaatttgcagcaccagggaaagacaaggagatttgaagtcagccaggaggtctttagacccgaccaagccaagaaaccaaatcaaggtttggatatggctgcaaaattccccaagtgggtagacaacatttctctagagttcagaaagggttctgattcttcctctgggtcttggtattgcctgactcaccctccttctcccccaattcgttagacagtcatcataggagccagaggagaatcccaaaggcttagaaacctgtgagatcagatatctaatggccctcttatgaaacaactactttgtaatgctcaccttgagtataattaaataaaattcacggacagtacaacctactaaaaaacaacaacaagaaaaccaaaccccaaacctgataattctctaaacttcagcctagctctgctagacatgtaaaatgtctcaagcctgggaaaaatgcatgtttctaagatcttaaaagcattgaactataaacatcacctaacagttttgcatcagagataagccaggactggttttccttacaacaggcaaaaacttcagagttttataaaaactcacaccaagttttatccagtcaggattactgactgtcatcaaacaatttaaaccataaatccagccttctctctttattctacgagacagtcattggggaagctgcattatcttgcatgtgtttcattaccccaaataaatatacacttagcactcaaattttgttacattaagctttttacctaattattttacaaaaaaatttttacagtgtttacacatcactttaaaaatttaatgtagtgctttaactataaataaaagaaatgtaatttataataatatatatttcaatgtgaaaatgcttgagtatgatacactagaacagagattggaaaacttgtgcctgctagccaaatatggcccattgcctgtttctgtactgcacaagagctaaaaatgaatttacatttttaaatggttgaaaaaaaagggttgaaaaaaatgttttgacatgttaaaattatattacattcaaatttcagtgtccataatgttttattgccaaatagccaaacatatttatttacatagtctctagagttgctttctcactacaatggcagagtggaatagttatgacagagaccatttggcccacaaagcctaaaatgtttcctccatggctctttactgaaaaaatttgttgagtgctaatttacatacataatttcaaaaggaaaaacaatcaatataatcaatatagtgctttaactataatacaagggggaaatacaaggaacataatgtaaaacaaaatattatatatttcaatatgtaaatacctgggcatggtgcactagaagaagataaaatgaagaagttggatgcttaattaacacagacacaaataacaacttcatattatattagagattccagaatccacaagtggcatttctctcaatggtatgtggttttccaaaatagtgaactcttgggaaagattagaacacaattaagtaccaccttctcttgatttacatgatctttgcattgctaaagaaccaggtataataaaactttgtaagacatgctttgtgtgtatatgcaaaatggagtttgattggagggtcaaataaataaaacagtttttccaatcacttgaatgtctgttgggacatgggataatttatcgttgtttctaactatctaatatgttgcagagcatagcatctctgtccccctttagttgttgctaattgccactctttcattataacaatcttaagtgccctcacccatttccaaaatattcccccagaaacggtgacatccctattgacagtcactgacctaaaggtgctatttatagtacttacatgtgctaaaagaggataaaatgaaacattatgttgaacactagaggatagcgctttgtctaagtagacaaaagatacatctttccccatctatctgaattgtagtgtcatatggaatacatttgccaccccattaccccattatatgttcaaatattttttctactctttcctgccatttgaccatatcattaagaaactttcatttctacaagggataaagcagtaaggaaaaaagagaaagcatacatgcatgttgtcaagacggcaaaaaagggaaagctaactctaataaaacctgagtaagatgactaggttctcagatttttagatgcattcctagtccctctttttatctctcttcttacatgtgcatatcttccacactcccctctaaggacaacctatcagtcgaactgaaatatcaatttaagaaacatctatctagaaggaagaagaaagaagcccctgggtaagtaagagtattggcactgacaagattatcaccaaaagcttctgttccatccagaaagttgcaaaacactttgctctttcttcatctccaatcattgcttctttggctatcacatccattcagaagcagaactatgtaagattttagcaggtaataagacaatcagaccatctgaataaagcctattgtaatagtagaactgcagagctcctgttagctgtctttgatgtgcattgtgaagaaccaaattcaccctccaaaaatcaatcagctggaagagcccatttgatgtctatcaattacaaaatttaatggctgcagactagaagaaaataaagatgatttatgtaatgttttcaaattcccttggatgctcaggctggcctcatactgtttggtaatttagaaagacaggatggcacatttaaaaaggtacctcacttaaagttctgccacagtactacaagaagtttattatagatggatctcctagagaaatacaggattcttattttaacgcctcccaccagatccttggtagtcatcttgttgttgtttacatgtgatttgaagtgagtgaagagctgattgagaattcctcagagcaaacaggtgaacagagagccgcctgagcttttacagcattctatgctcctctttgcctaggtatggatcagaattttttaatgtgcaaccagcccctgggaaaaatccaggtgtctaattaaaaaaattgtgttgacaataaaaattgtcatcactgccagaggaaaagatatacatagcaaggaaaaatctatttcagttttattcttggtttatttttcactgtggcagtttgagaactgatgattttccaaaggaaactctgaatctcagaattttgagagacaatgttcattgctccaatggcttcttatacaagtgagcagaattatcttacataattctacttctgaatgaatgggatagctgaagaagtcatcgttggggatgaagaaagagcaaagtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcaggggtgtagctgtgtgccagtacaattttatttatgaaaacaaagagctggatttgatctgtaggccatagtttgctcagttctgtcttggatctaaaagatttttgttatccagttctgtttcttacttaaatgttcagaagtgagctactttacaaaaaaaaaaaaaaaatcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgccaaccaacttaaaaaattatgttcatatacccactgaccacaaatacaggcatcacaccaacaagtctttggatccagactaaaacttcccaaagatgatgtgatctggcctgtgagtagatccctatcattaacagagcttactgctccaagtcaactaatttaactaacttaggttcagagaaaacataactgcgaaatacctccatttggaaattacagtggtctcttgacctggtgggaaacaagacttaaaagcaacatctgagatagcacagttgaggtagggaaggaaatggtgcaatagggaacagaagagccctcacaaagggatccagttggggaagggatgttgcttaataaaactccaccatcagtcaaaacataccaaaccataagcacatacattgcaaaaataagcttccaagccctgggtcagtacaattatacctgtgccaagtggtctacaactagcaaagatgaagccagatatagaggagaggcagagtacatacactgctatggttacttcattttaatgtaatggtagaagccctgaatggttgtttccctcagaaattgcatttctccactggaggaggtaattcaaggaggaaggtaccaagtctactgaccaggaaacaacataagttggaaggtaaaaaagtacttctaacattggatgcatatccatgacatcacttctttccttgcatggccaattttgtgttctaagtgggaagcaggaacattgagaagtgcatggatcgtcagaagaaacataaatgactgccccattgagctgcatggcactcactagactaacggggataatgcccttcctcaggtggttgacttttacaacacccggaaggtatttttcttctgtgcactctctgtattatgtgtggtcctacattctaacatttagatagtgccccacactatctgtttccatatcattcatttccacctaaccgtaaccttcctgaggtcagagaatatatcttattttaaaattccattatttggccgggtgtggtggcttactcctgtaatcccagcactctgggaggccggggcacgcggatcacgaggtcaggagatcgagaccatcctggctcacacggggaaaccccgtctctactaaaaatataaaaaattagccgggcgctgtggcgggcacctgtagtcccagctactcgggaggccaagacaggagaatggcgtgaaccggggaggcggagcttgcagtgagccgagattgcaccactgcactccagcctgggcgacagagcgaaactccgtctcaaaaaacaaaaacacaaacaaaaattagcagggtgtggtagtacattcctgtaatcccagctacttgggaggctgaggcaggagaatcgcttcaacccgggagacggaggttgtagtgagcagagatcacaccactgcaccccagcctgggggacagagcgagactccgtcaaaaaaaaaaaaaaaattccattatttatgcaaaagcttagtacataataagtgccagaaaaatattgggtgaatgcctgataaacgtggtagtgaagttgtatattataccaacttgcagtccagctcacacaatccttgggaggttttagtctctatccaaagacttgtgggtgtgacgcctatatttgtggtcagtgggaatgtggacaaaagtggtttcaagttggttgacaagcccacacgtgcttgacagatggaagagtaccaggagctgacaccctgcctagggaaatcaaagccttagcaaacccacttttatttagcacaatgtgtttcatttaaaagcaaaggggaagatgtgtcatacctggaactatttacatctctgtctttctttgcttttcctgaattcgcaagacaggatgaaactcatttctatctctccatcctatgtgaaaaccccacttgccatacaaactagacaggacactcagaacattgagaattgaactggttaatgggtgacaaagtgactatttccaaagagagaagatgggtatgacctagaatcaccttgcgtgttggaccagacctaagcaagctgacaaaattatatttgtgttgggagataagaaaaaaatattgatggcgggtagcccgtattactttcatctaaaatgcttagcatgatactatttttaagaagttcaaggccaggcgcagtggctcacgccactaatcccagcactttgggaggccaaggtgggcgcatcacgaggtcaggggatagagaccatcctggttaacacggcaaaaccccgtctctaccaaaaatacaaaaaattagctgggcttggtggccggcgcctgtagtcccagctactcgggaggctgaggcaggagaatggcatgaaccagggaggcggagcttgcagtgagccgagattgcaccactgcactccagcctgggtgacagagcgagactccatctcaaaaataaataaataaataaataaataaataaataaataaataaataaatattaaaataaatagagagaagctcaaaggtaactagacttgaaaatcatcaggaggaaagtccctattatggctaattctcagcctagtattctagaatttctgcaatttgggtttaccacacatttaatatcatttctcataaaatttacaagagtcattcttcctgctgtccccaggtataccacgtttattactctctccacaccttcactctgccctttttccccccgaaattccttctttgtctactttttcttgacctggtcttactcaattctcaaagcctctccaatttacactcctttcaagaaaggtgtactgatcattccaactctactgtaatccctaacttccctgaatttcagaactttagtgtctattcctcatttgccattcctgttaattcaagaaacatctagtgagtacctatgattgtcagtaagtattctaagcattgagggtacaaagttcctgttttccatgaagttattaggtgggcgcaaaagtaattgtgggttttgctgttaagtaatggcaaaaccattaacagcaaaacccacaatcacttttgtgtaaacctaatacattctccgggagggagacagagaaaaggaaagaactgaattcaaatatataagaaaaattggagaaaagtactctgtgatatagagggtgaggtagtaaagtgactagaagaacatatgagattgtatgacagtgatggtctctgaaattatgacacttaatcagagatttaaataaaaataattggcttcatgaagatcagcagtggtagtatttcaggtggattcaaagactgaaagttggcagaaataagtttggcttctttaagaaaactaaaagtggccaataggtgtgataatagtagatacaggggagaggcaggctaaaaatgaggccggacaatgtaagtagcggcccaagagaaaggtggtggtggcttcaactagggcagtgctggtgaaaatagaacatcataagatttagatgaagcggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgttaacctgggaggcggagcttgcagtgagccgagatcccgccactgcactccagcctgggcgacagagcgagactccgtctcaaaaaaaaaaaaaaaaaaaaagatttagatgaagcatggataagacttggtaatgaactggatgagagaagttgaagacttctctcaaggaaaactcccaccctttttagtctgagtgactagatgttgacagttactgagatgaccagggagactaagggagtaatttgggagcatcttcagtctcctcatggctgcaacactttctttgtatatttttaacatatattttgctattacttctctctccctgactaaattaaagctgtctcaagggtaaaaatgttgtgctttgtcttccataatgcaacacatatcgtaggtacactggcacagtgtttgacaaatatttgcttaataaatctaggaaagggagaatgacatgtgaacctccatttataaatgttatttacaagttttatagaaatattcactctgatgactaccctctatgatttccttggaataagtttaatgataaaaggtccttagaattcaaagaagagtgtaactcaataatagtggaacacaaaagaaaagggacaaaaagattacctctaatctctgtaattttaagagggtaactataattttgcttctttcaccaaacattacgtcttgttttttcattcttatttttaatgtacagatactagttattttagtagctatgccataatttaccaattattccttccctattggttatctagttgtttgaatactgcacttaaccttctcaggtacaaagcttccctcactcatcctcttttagacctttctttagcacagtgagccaaaatcacagtcaagggacagaagtatatatgttgagttactttgtaaaaaatgttataacaatctgcattgccacaaaagtataaattattatttctcaaaggaaaattctggtggtactttcaggataactacataataaaataatgctaaccatttaaatataattttgacttctgacaaataggcaacttaagaagcatcattagtctaatgaatgaatctgttctgtcatcagctcatgagatggacatttcatagaaatctattccatatttttactattatttatctgtttggaatcaggtatagatttattctctgtaaatattgtagctcctttttgtagtagagtgtatttatgtttttaaacagatggatgaaacttcagatcccaagagtacaagtccatgcctaggttcatgcagcctcccataaatcatagcaataaggaaaatgtgtatgtgctatattcagaatgctaggagcatactaataactccatttttaaactacaattggaaataaactactggtaattcctaaaatcaatgggtcagtcaattgtggggttaatctcatgtcacataaaactttctattacagctgaaatctctgaatgagactaaaatctccttgtatctctcttaagcttgaattcagcaaggctaaatgcaacgaaaagaaagaaatccagcagaattgttggtttgggaggcagtgtgaaatgatggaaaatacatggcaccctggggttaaatcacaaatttgctactaattgtgtcactttgggcgaattatttcatctctttttaaaaaatgtttatttgtataaatttaaaaagtacaaatgcagttttttaaatacagatatattgcttagtggtgaagtctaggcttttagtgtaaccctcaccttaatgggtatattatactccttaaggaatttcccatccctcatccccctcactctcccacccttccaagtctccaatgtctattattccactatgtccatgtgtatacatttatagcttatagctctcacttataagtatttgtgatatttgactttctgtttctgagttatttcacttaagctaatggtcttcagttccatccatgttgctgcaaaagatgtgatttcattcttttttatggctgagtagtattccacggtatggatataccccattttctttacgcacttacccattgatagagacttatgttgattccatatctttgctattgtgaacagtactgctataaacatatgaattcagttatctttctgatgtaattatttcttttttagagtagatacccaatactgtgactgcagattgaatggtagtctatttttagttaccaagaaaactcctctaaattgtgagccaacttgtggaagaaaaaagatagccctccctgactgaaaaaagacttaaagagcctctgaggacattcgtgccatttgtgagtcaaagtacagtcactgaagaaacttggggaacagaatataagacttgcagcaggaaaaaaactgattcagggaactcatgcaggaaacatgtggtcttcgctgggacaaagcccagagaaagcccaatgcccggtagaaaagtaggcaaaatgacctattaagtcaatttgccatggtgggacataaagccacatgcaaaccataggaaaaggccagggcagatttattttttatgtatatcatagctcaacatagttttgtccttcattctgattctgatccacacagcatttgctgagcatgcactatatgacaggtgctgtcacatacttataagtggtagagccagtgaattatgaccatatctgggctttccacaagccaaactggagtttcattatataaataaccaagaccaaactaaaatttggaacttgaattgtctggagagttgtatctgaggagatttgaggaccatccctatctcagctactacttcaatgaggatgattctcaaatttatattccccacctggattttttattccagttccatgcaagcttttcagcagcctactaattagaatactgctattttccaggacctcatgatcacaactgtcttctgcccctgtggcaaaaatagtgctactaaatctcccaatatttatttccccttcttccttaacaaggaaaactctggttttagtaagacatcacagaatacagactatattagccatatctcctttgtaggtaggtgtggacatgtgaataagttctggttaatgagatgttagaaaatgtataagagttccaggaagtgctaaaagaaaatgctatgcctctcctcacctcttccagcaagccgggatgtggacatcatagctagacttcaaatagccatcctgaaccatcatgcaaatgccttattttcagcatcaagatagaaagagctgggatccctgcatggcctacatttataagatataaataaatctccatcttatttagacttatccatcactcatagctgaaactaatcctagctgatacacacttgccttcaatacccatggagtgaagacattgactctacttctgctatagctctaatccattctttccttcacatttctactgcctagacacagatcctagacaaaggccctcagtgattacttaaatggccaattatagtggcctaataactggactcctatgtccatccatgctccctgctgtggtcttcacacctcctgcatgattatgtttcctgtttacagcagcactgtgtccatgtcgtctttcacttttgaggggtagtgaaagacatgcacagagtcttcctatgaagctcatttaccagctatttacacagccaggtccaaactcattgaccatctttcaagtctctctgcaaagcccttcaatgactccctattggttacacgataatgtgcaagtgttccaatgaaactttcaacaaactgtatggtgtggttaacttatctgttttccaaaactcatcctatctcctttgggcatcttttctctgtgctctcatggcatttattatatacatttacttataacatatatatttttcttaaataacctcttcatgagattgtcctcctgtcagaataggtgccctgtaaatgtatttggactgaagtaaatttagacatttgtttctcactgaccaaccctagtcagactgaactatctgctcttggtgatgtttgccatgtgttcacactatttacttttactggaatatcatattctttactgtatatccaaagtaaaccaatatttcaagtgtttgctcaaacactaccttctaaaaaccttccgtggtttctccagataaaagaaagctctattataatctctgaagtttcttaccatattgtatacaatttatttcatttcagtccaattcgatatgattcaattcaatcaaatccagaaaatattaatatttagaacatactcattatgtttgcatactcattctaggtctttattttggagtggtttacagtgcaatgagaaataaggggatgtctttaatatattctaggctaaagtgtatgcaatatacaaattaagataatgatagtgttgacaatgctagtttacctgcgagaacaggcaaactctaaaatctcaatggcatagtacaagtttatttctcatacatataaatttccaaactggttttcctgattggcatatagctctccaagtcagggcccaggtttcttctgtcctgtggctctgctatctgcaatacaagacttcaaaggccgctatgctgtgtaggtcaagccagaatggaaaaaagcgtggaggatttttcaaaagttgttttcctggcttaaacctagaaataatattcactacttctgcccacatttcattgactagaacttggcctctttaatacaactaaatgtaaaaggaggctagggaaatgtagtccagctgtggactacacagtggtgttggattggatagaactgagggaagtcttgtagaatccctcacacacaatgacactgaagagaatttgaaagttttccactcccttaaaatggaccaagaagaggagtaaatattttttggagaacatgcagccagagtggttataacttctaatttgtctagaatattctatttgcatttgttgtcccaatattgttataaaatggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcctacaacctatctctttcccctgctttcttactcaccatttgccagccaataagtcaatacaaacaactcaattggctacagaagacacaattactagaaacctgatgacccagataccttttcttgtaattaattaattaattaatttttgagacaaagtcttgctttgttgcccaggctggagggcagtggcctgatgtcgtctcactgcaacctccgcctcctggattcaagtgattctcttgcctcagcctcctgagtagctgggattataggcgtgtgccaccacacccggctaatttttcatatttttagtagagacagagttttgccatgttggccagactggtctcaaactcctcacctgaggtgatcctcctgccttggcctcccaaagtgctggggttacagatgtgagccaccgcacctggcccctttccttgtatttaaatgctagacaaaaagaggcaaatgtcaagaaagtaagattagagaaattaaaggttcagtggtagaaggtatggagaatggttccttcttccctgaataacttttcttcaacagcaaatattcaacatgactccctatgctgtcttcaattctgttctatacagtgagaatagctgccggaatgagttgtattacaacatattgaatataataagttgtaattatcttatacagaaattatttaattacatttaattttctcctaaatatgaaacagcatgttcagaaaaatgaaaatacaacatagaattatacatgtgaaagggagatttaagacagtgttttatgccccccttatttatcagatggggaaacagagtcctagaggaataaaaactttcagaagagttaacggtagaagccaacactatgaggtctctggtgaccaaattgctgctctatcaactacatacaaaaggattttaaaaggagctgaaggccattatccttagtcataggaccagaacaccaaataccacatgttttcacaagtgggagctaaatgatgagagcacatggacacatagcagggaacaacatgcactggggcctattggaggatggagggtggggaaaagggagaggatcaggaaaaacaacaaatgggttctaggcttaccacctgggtgatgaaataatctgtaaaacaagccctcttgacacaagtttacctatgtaacaaacctgcacatgtacccttgaacttaaaaaaagtttaaaaaaaaagtcataaaaggaagaattagttgtcagctaaacagaacatctgaattcagttatttaggataattagttcagtagtcagcaaactccaaagtttttaaatatcacatgcagtcattctacctaagaaatgtgtaacaatgagattctgtcttgttggcttatagaaaagtgactctagaggagtatgtgcaccctgtataggaaaattgagtggaagaacagtttggcaagctcctgggtcacaagttacagtaagcaccttttgttcttccattattcacctccagcactctaccacataacctcaagatctactcactttgtacatcaaagacagattattacaaatgaaaagaatgaaccaataggaactgctttccttgagatccccctctaaaagttaatctttcaaggaacaaaggaaaatgcacttcaaaataggcattttccccctcaaacaataggttttctcaaatttctgagaatgccaagaacactgtgtttttgttataaatgttacatgccagcatatgattacaaaagcaagaaatgaaaagaaaaaaacccttacactttttaaaatcacaggtgaggcagatgccatttgtaagagctacaacatccttaactttcagaaaagaaaaaattaccaagcacaaaagtgaaaaatacactatagattatatacaaatctgtcaataaaatgctttcatcatggtggccaggtttcacagattatgctttgtttagaaagtaagcaattccatcattaggctaatgctccacagtgctacaattctacttcctttggaacaggcaggatcatgtaatcacgaatttcaaaagatgggcaaaaccagacacagaaaacgttccacatgctactgatgcaaatgttgtactctaattttcaaggtcaaaaagataggataggaagattacagaagtgtgcaagaaatacaccaatattgaccttaactgagtttttgtgtcactatgtgtacacttactatggtgttcaatgaaaagatgctggtcttggtgagtgtacaatgtgtgaaagtgtcaccacagggaccaagggtgggctggcattaggtcttggacttgagttggattccaaggttttcttagcagccaaaagttagccaagagaagaaataaaaatagctaacatttaaatagcttttataggaaggcactgttctaagcattttatatatgtattgactcattaaattcacatcaactctcttttgtgttacagtattcctgccttctctgcaggggattatgttccaagaacctcagtggatgcctgaagtctcagatagctggtgactatttatactgttttttttttccctctatacgtagacacttatgataaagtttaatttacaaattaggcattgtaagacattaacaacaatagctagtaaacaatagaacagtgataatatgaaatgtatatatattttatatgacatttataatatacatattttaaaactctcaaaactataaattttatgcatgcatgcatatgtggtaaagttataaaaccatggatacatattaacttggagaaattggttctctatcttgagaagaagggagagatggggaatacaatttggaaaggatacacagattactaaaattttatttatttgaaaatatcagaaacaaatatggcaaaatgttaatatttgctattttagaatgatgagttattagtatttcacgtattctcagtagtttttccagtatgcttaaaagaagccatgattttaaaataggcaaggaaaaataggtatagttgtaaacaaacaagttattaagtaactgtaaacgtgtttttaaaaattagctagaaaaaagcaacctcagaagggaagagtaagatagataaatcagtaagatagagatcagtgagaatcttcatagttcaaaagtgataggccaagtaggcgtcaattcttaaatagatgtagttttaatgaaatcctaattcagtaacattaagggattcttcagtaacttaaaactgtttccaaaattacatggaagaacaaacaagattttttaaaaagacttacttgcagagatatcaaaactttataaagttataataactaatatgatgaggtattgataagtaattgacagatcaattaaacagcattgatgatgctgaaatattccctagcatatttttgtataagatataacggtgtaaatatcaaaatctacagcaaagaagtggactatttaacaattactaagaaaattggctaattgtaacaaaaattattatatttgtcataatatacatcctggatagatttaaaagttaaatgtaaaatgaaaattttaaaataggtaaatagaatataactatttttttctgtaaatacagcatctttaagttaatgtaggttcctctttgtcctaaacctaagggttttttatgcattctaggtagaccagcagtctaactctcacagaacattcagagaaattaaaataaattctgcccacacccctacatgagatgaactggaacgtggtgtaaaactgggttacagatctatgtagattatctgatgatctgggcttctttaaaggaaagataagtggataccccagggaagttaccatgaaccaaggaagacaaagatttatgtaaatagctgctgactacacactctttttagtaaacttacaaataacaggattttgaacaatacagcattagctaaatatattatggaacactcacactaagaaatattaaataatgttttttgaagattatgtaaagacagaaaaatcctcaccaaaaaatactatctgaaaaaaatcagcatataaaaaagtatataaaatatgatcctaattttgagaaggaaaaaatatctggaaggaaatacaaccaaatgttaagtgaggttattttcaagtgttatgatgatgaagtgaagttaattttctaaccactattttccaactttttgtaatgtgtattttttatgattaggataaaaatggtataaaaatttttaaaaaggcaaaacctcccactgtgtgctgagcttccccgaaccagtgaactagatttcactgaggaccctaacaacttctcagtggtaaaaataatgagttttcccaacattaagatttaattttcagtggtatagatgggagcaagaaagcccaaaggacattgaccgtttctgagcctaatttctcactcccgcacattggccactgtgctgctggctaaacaatttccccccattctcagttactcgttttgctcatgcataaaagatacatgttaaatcagagaaaccaccctaagggtgattgatgaggaggacagcctggagagttacttcaagctctaagctcagggaacttggtaacactttggactcaattttgatttgcagttgtacaagacaatgaacattgctgttggagggggaccttgctgtatacactagaattcaatttagcaggaaatggcaaacactttagggaacccaaagaccatctccatgatacagggtttcctaagaggacttcctaagagggctgcacaatgaaacgaatgtgccctggaaagacctgctttctgcatagccagtgaggttttataagccatgggtaaaatgggataaatgttacctttgaaaagtatatgccgcctatgctcttcacatagggcttctaaatcactacacaaacttctacataccgatatatctttctgtgggagggatgagttaaaacaacctgtctttctctttctctttctccgcctgtctgtctctgtatttgtccctgtctccttctgactctctcctttgtctgtttctccctcttcgtgtgcatttctatgagtgtctgtttgtatttttctcagtgtctatctctgtctcattctctgtataacattccttctttcttgtccacagaattttttcttaaaagggaaggggactaatatagcatttactttttctggcactatgttactttatatacactatttaattcaagccattcagcaatcctaagaggaggaaaaacgtttttaagaaaaaaccaaaaacttttcttataaatcaggaaactgaagcttacagaagaattttgtccaaaggccacctattcacagaaaatggaagatggctgttcggtaatgagtccccgtggaccccggagtaacacccttcttagtatgtggacatgcttgcagagtgcaccttctccgtgatacaaggctattcttcctaatccatgggctgggaaatccatggcctaagatgcaaactgacctaacccacaggtataaaggcagcagagcaaccagccctccatccttcccacctccattcctttcctgccagctctctttttcacttcctgcaacctgattttcattcctgagacaaaataaatgtatccttcacagagttttctgatgttgaggacccaatgtccttcactcagtccttactgtacttgctctctgaggattgaataccatggagctcatcttcttaaactgctttttccttagcttctgtaagataatatggcatttgatttctatctattctctgtaaaaaataaaaggtaaaataatttgtctatgtaagtcctcacttaatgttgttgataggttcttagaaactggaactttaagcaaaacaacgtatagtaggtccttcaataatatcatttccttcaatgtaatgttttatcatgttgacgagaaaaaaaattggttttgtttatatgttgtttcacttaaagtcagtttccaagaatctactggtaatattagtgaggacatactgttcatatatgtatatatgtgtagatacatatgtacacatacatatatcagggaagtaaagaggacatagttggggaaaccaagcaacatagagatgggcacatactagctgcttaatatattaatttattgaattaatgaattaaccaactcatagaattatctcccaatcttcatctaagcaaatctttcactccagccaactagaaaagtgccccctataaatgcaatgtgttttcttgctcacattcatagacctcatctgaggtttttccctctttgtacaaatgctatttacatcctgaccgaaaccatcaccaacccatggaaaatctcctttgttgctgtgaattgaaacaactcttcctctctaaatgtttatgacaatgttcacctatttagcaatttatcctttgcttccctgtggggtttttaatcatcacttaacttttgtgttgttatttcactcctctcttgttgtcattgtctcttcaactaagagaaccatacttttgtgtcttcattgtgcccctctaagagaagatgctagtataaataaatgtttaatttattaatattttgaatgcaagagaccagtgctcctaagtattgctagcttttatgcagtagaatggaaaagagggcaataactaaattttctgagagtctcctctgtactagatgttttgcaagtatatcttgtttcattctcaccagaaatttattaggtagtttttaccttatttatacataaagacactgaagttcaaagttacttgatcagggtcattcatctggtaagttggaaagctggggcctgaaagcaagattcagctctaaagattacatccttaagatgagttcatgtcctttgcagggacatggatgaagctggaaaccatcattctcagcaaactatcacaagatcagaaaaccaaacaccgcatgttctcactcataagtgggagctgaacaatgagaacacatggacacagggagcggaacatcacacactggagcctgcggggtgtgggggctgggggaggaataacattaggagaaatacctaatgtaggtgacgagttgatgggtgaaaaccaccatggcacatgtatacctatgtaagaaaactgcacattctgcacatgtaacccataacttaaagtataatttaaaaaaaacctaaataaatgtataaagcaaaaaaaaaaaagattatgtccttaaaattgtgtcacactaaacaataaagtttctagaagaatacataggaatgtatcgtcaggaaactggagtaagcaaaggcttcgttagcaggacactaggggaaacaattaattggacttctttaaaattaaaaacttctgttcacctaaagatatcacaaaagagtgaaaatgtaattcatgagttgggagaagatatatacatccaggcaaaattattgaatttagaatatactgtatccaaaatatactcatacggtatccagaaatactttaaaacttaatagggaaaagacgaagtcttttgttcatttatgggcaagagacttgatagatccttgataaaggagaatatccaaatgggcagtaagcatatataaacttgctcaacactactcaaatttaaaccccaatgaaatgccactaccaccaccagaatggctaaaattaatacaatggataatagcaagtattggcaggaatgtggtgcaactggaattctcatatactgctggtggtaatataaattagtatagccactttgaaaatgtgtttggccttatcttctacagttgataaaaactacaaatttcatctactctatgacaataatttcactcctaggtatagatgcaaaaaatattagtgcgcatgtctactaaaacacatgtacaagaatgtttacatcagctttatttatcatagccaaagactgaacaacccatatgtctactgacaccagaacagagaaacacatttttgtacattcatacaatggcctacaaattacacattaaaagaatcaacaattcctaccttgaacaacataggtgagtctcaggttgtagagtgaaagaagccagacacaaagagtacattctgcatgatgttatttatatgaagttttaaaacaggcaaaacaagttcatagttataaaggtcagaatatttttttcctctattgggtgagggcgaagggtgttggtaattgactgggaagggatgggggtgaacctatggagtgatgaaaatgttccatattttgattggtgtgatagttatgtagtatatacatgtgtaaaattaattcatctgtacaattaagatttgtgcattttatatgttaatctcaatttaaaaagcaagtaatcaaccaaacagcactctgtcatggcaaatggaaatatatttgtaactataccagtttcctgaataagaatttatatgatctatccattttatattaataattaaggtccaaggaaaacatttgtctctcctgacactctggtaagattccctttatcagataataaaaccatatatcctgtcctgtctcacctgtgtcaggaagcacacacgaattcaatactaaattaatcattttagcctgggttttggtatatttactttcattctctctttctgctcctcactccccaaactccagcctcacttcccttctgatgaaaatgttttacgtatgccgttcagtacctcaaaaccatgttggatgtaggtaaggatataacatgacgtgctaaatgaacaaggtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgtttatgaactaggatatcccatttttaaaaaatctagaatggatgctgagaagcaggattgcttaattgtagagtatgcctatcttggaacaaattagatctctctaaagtggttataacaatttaaaacacatcttttggccacagttggtataatcacatttttaaatgtgtgtcaatagatgggtttgtaatggtatgctactgcaattttaatttcccctgaatcccagtgaggctgaacaaatttttcatacatttatggctgttggaatttacctataaacagtcttgtttatatattttgtacatcaaatggtttattagactgtttgaataattctggttccagaacattttacttctcccagaaaagctcaaccaatttctcttgcacttctaattttcagaagttttttaaaattgaacccaaatctgtattgttgatatttctatccagtacactggttttgcactctgggttgacacggaataagtctgacctttctttcatatcactgccttacatatccatttgttcattgacttattcattcattcattcacatacttactcatttattcatttcagcaaacacaaattaagcactcaccaaagtcaggaataaaacctgggtcaagtcatcaaggagacacagtttgatagaggagacagacatcaaattaactaatgatacaacatggtaagcccagtaatagtggtatgcacaagaaacaaaggtaggacagaatgaggatgactttaacagatattcaccctctcaccacaccatttattaaaatagacatttctataaaacttgcctgcaataagtatccactgtcatagtcctcttgtgtatctttcccccgtcacctggccactcttccagcggaggccccccaatatttctatatcaactaagggggtggcagggtgtgggagatacaccaggaccttatgcctgtgctgcagctggcctgttttgatgggttggtgcccagaactgctgttacatatttgactgtcatatttggaaggagctactttcacttgtgtcctggttacaggtattctcactgtcccaatcactctctgtcacatctatctttatccttcatacatgatagtgctcagaacaatacataggttcatggaaaaatagtctaagcacagtgtttatcaaacctcagtgtgtgcatgaaacatctacattttttgaaaaaattgtggatatgactcagaaggcctgggctggggcctgagattctgtatttctaacaacttgcctggtgatgccaatgctgctagtctgaggaccatattttgagtagcaagggtatttgcagcttaaaatgtagttgaaccaacaccaacataattctgacccaacaataacgacccagcccagtgtcaaatcagttatctgacaacagtgtcacactacagacatgtactgacctaagtcctgtactgacctaagtcctctaagtctttttaggaagagcaaaaaagtcaatactacttcatcttctatttatggagatatgtttttgtatacacgtatctctttgcagctacactagtttggaggctagtgacgtcgggaggggcctgtgatacctacctgttcctctaccgggccagtccatagagaaggtatacctagcatgcatccaacaatgcacctgagcttctttagctgtacaagggcccattgctatattaaagaaatcctccagggagctaaggctctaagacacatctttacaatgtttcattcattccttcaacaaatagtgcgtgagcattcgtacctggtggtcattgctttaggtactgagacaaagtgcttcctctcatggaatttatattctgctggggtcagatgtgctccaaaaatacatgaataaataaacaagaagaatttcatatggtggtgttatgctgaaaataatagcaagaggtgagggtggcagggtggctcctatggactgggcagtcagaatgatgtcatttaagctcagacctgcattattagcaggaagacgccatgtatagataataagaaaaaaaagggtcacaggcaggaaaatagatggtactagaatttgaagcaggaaagagcttaatatgctcacagactgggaaggtcagtaaactgcctggagcataatgaatgggggttgggatagaacacactgacattgaaaaggtagaaaggggttagatcctgctgacctacataagtcagggtcaggagtatagattttattctaagtgtgatatgtagccttagtgatcattgaggtttttggattttagaggtagactctgtaaggctccagatagaattactgggtagctactttttctgtttgtttttggcatcagcagtcagttggctgttggggtcacttacttggttggggaaagttgttgtatgggtgatgtttgaggagagaacacaagagtttcattggatcatggtaagtttcagatggctgccagtcatccacatgttggtggcaagctgactgttggaaataagagtcctgaagactcaatgtgctgtcgggcaagagcaaaagacctggcatattcagcagatggttcttaaggcatatccatagggaatgtcatactaacagattgatcagaggaggaaagaccagcaaaggaatttgagaagtggccagttaagtcagaggaagactgaagatatggagtcttgtgaactcaaagaagtgtttcaaggaggcagggcctgactatatgtgatgctactgtaaggtcatggtagacaagaacaagggaaaaccctctagatttggcaatacatagatcagtggtgaccttgatgatagtggccctagtggagtggtggggaggaaagtctgatcagataggttaagaatgtcagaaaggacgtaaaaataatgattgtagataataagctcaagattttatgtgaacggagtgaagagagtggtagttggaaggaaataagagatcaattttttaataggagaaccaagagcgtatttgtataataatggaaatggactagttgaaagggataatgtgatgattcaggaataaaggaagatataattgcagaagcaaagaccttgagaaggtgaaaaggaccgggatccagaccaaagcattaggattgatttctgataggcacagagatatcatcttcatagaaacagtactgaaagagacaggatagagatacagatagtttatttgggcagtgaaaaggtataggagtttctgtctgcctcaattttcttctatatttgagaaaaaaacataacccattctcaagggcaacaggactctcaaaaaaaacagacaagccaacacctagtgggaccccacaaactacaagtgaaaacaaaaacaaaagcaaaactctacatgaaagtgggcaagaaagaggtaagcaacttctgaacagagaaatggggagaggaaatgtgatatcctcaacagcataaaaatgtcttaaaattacggaactacgtcttatcctgtctcagttctcccacaccatttctgacacttaaaatggtgccattgacagccttctccccatatctggtctctcatgctggtatgctgaaactctcactcctcctccaaggaacatctcaaatatatcacccccatcaagcctttcctgatatccatcagtatcacccaccatcgatcttgccctactttgatttctcacagttttattacatgcttagtaaggtctttcttgtactgtattatagctttggtaggctttttggaggaaataatgatatcttcattgtctatgatgccttctaaatatttttcgctactctgacttacagtccagatattagctaatcctttgcccagataaggcttactcttttttggttctaagtcaatgtagttgcaaaattcagaccttcacatattcccccaagaattctagtctcgacaaccctgagaataatgtaagctgatgccaccattccctgctggcaggatttttttgggtacatgttgatggcctccagtaatgagatgcaagtgagagctaagtccccttctcccaacccagccactaggtgagatgctgcaatgaaaacatgtatctgactaatttctgcaacacatacatccttttattcatgagcatgtacacaattttttttctcatatgagatggcgaagcaccatctctgttaagacactttcaaaaggacccttgtatgaaaagattacttgaggcaaatgtgacatcatgtcagcagcagaattcagccagtattccagttaaaatcagccaaacaaattctctgttaagtggcaggtcataagaattattaaatggatccctaagcgagggccaccactagaaaggagcatacagcttttggacttgctagatcctcataccttatttattcaagggcagctgttcctgtgtgatgcttttgaccaatccacatgtcttgaagaccatccatttcaccaataaaaaattataatatttcttatgttaaccaacaaagtctctaggtagagatttaggtaaggagagttgatcacttgtcttggctgccattgaacggttgactactaataagtttctcttcagtgctaccctctggggtgtgtattcttctcaagggcacttcaaatgttagctattcctagggtatagataaaatcaacttaaacatatatagcatagggtttaaatagaaatattcaaaggtaaataatgaacacctaaattaataaatttctccctcccttttttctttccttccattttttttctctttctcttctgttcactttttccttggtcttccatactgaagagtgattgagtcattgtaaaggatattttggagtgcatattgtttccactaaaatttaaaatccacagacattgttgctctccaaagtccctccttagccaccctgacaccagcagctctgctttcctgaatcctgtcccctccacttgtggaatttcaaattactttcccatgtattctaactccctataacactctctcagcttttaacttgccaacctaaacaccaagattctcaggaaaacagagactcctccagagaattctggccggcctccttagaaggctgtttgtggaacatctttgtttactcaaacatgtccttgaggtctctaccttttctcatctccttagtaaacaactttgctgagcgattatttcaagcaaatgcaatgttgttaaaataaactaaaatggagaccaggcatgaaaaattctagagaagacagagataggccttgaaagtgaccttaaacttgtttgaatcgcaaccacaagtggaacttaacttgagctatttcttataaatgccaacattaagaaacatggaactttaactgaaccaatcaaaagctgccatctaacacagagttatgtaactagaagctttccagtaggacagacaaaacgaggcaactacataacccaaaccaatcagatatcttccttgccttgcttctgtgttcactataaaagcctccctcttgggcttcttcagtggaaccctgaaccacttgctgcctgattcatgagtcactgtttgcccgaataaactctatacaattttattgtgcctcagtttatcttttaacagtattcttctcaagaatgtaaataaaattttcctcaacctcattactaagaatgatgtttcattcttagtgtttaaaccttacaaaaggtccaaaattcatgtcatcccacatatattcttatgtacccttcaccctctacggaagtcacttactgttgacatgcatatacatcctcaagggctttcatgtattagattttttttttcctgctatgtgcacgcacttctcacttctttttgttgtccttgggtttacacttttagaattgtctcagcctaaggtaatcatgagaataacctggagattttgaaactacaaagaacgtcactagatcttttgaatcagagtctgagggttatacccagcacctgtgttttgtaaaaccatcttccctggtaatttttgtacacagccctaagtaagacttctccactatttagcgcaggaggatagcgttattgttttctttctttgggaaccacctgtggttagataattaaggcttttcagtgaccacaagctctggcacttgctccaggatcaactccctgccagtcactctcccagtcgtccacagcacaatccacagtgacttctaaggccagagaggcaagtttgcacttgttcacacatcatttttataccattgcttgtcacctgaatctcattcttgctcccccacagggagctggtcaatcttgctgaagagtgagtctgggtaagctccctcctaatcagagcaactcagtagtctgtgcctgtgcccgagactgctgacccttaaattagggaaactcaacatttgctagcttccctactggattaggtggccatgactgtttgatgctgcagctaggatgaactagggtgattttggcattgacgtttgtctttagtcacaaagctgggaactactgttggtgattcatatacacaaaatgaagggtgcagttcatcgcatttcttcttccaaggctctcatttgtttcaagttcatagcccaagtttctccttaccgcaagaggcagtccccccagcacttgggtggttaggtggatgacatgacttcacactggcatgggcgctgcctcacaccttagatgtttccacatgggcagactgatatagtgaagcaagctcgggctttggagccagactgatctaggttcaaaccccagctctgcagaacctaaagttctgtggccttgggccaatgaccatactttactgagattccatttgcgatccataaaatgaggataattaaaaaattaataatacctgcctcacaagtctaatggacttaagataatataaggacatctgttaggcaatcagcacctgctccttcctcctttggctcccatacaaaggagggtggggtccctcatcacacctcctgccttttttttttttttcttctctgagacagtgtctggttctggctctgtcacctaggctgaagtgcagtggcacaatctctgctcactgcaaccttggcctcccgggttcaagccaaccctcctacctcagcctcccgagtagctagctgggactacaggtatgcgtcaccatgcccagctaattcttgcatttatttgtggagactggctttcgtcatgttgcccaggctggtcttgaattcctgagctcaagcaacccgcctgcctcagcttcccaaaatgctggcattataggtttgagccactgtgcctggccctcctgccttgttcttagctgtctttctcaaacgagggcacaaacaacaataactactgggagaactttgtcaaagcatccattctcccacccctagatccaaccctctttgaaatctccaaccttacctccttctcctcctctcttggtgccttcctggaatgtttcccaggtgctggactccacggcacaacaagtgaagcactgagggtactgacttaaagaggcattcaccctctcccaagtcctaagcactgactccttgaattgtgggccctgggtgcctctcgctagtcttggccctgctagggctttccgtcgattcatcatttgctgcacggatgacaaccatttcttttctcccagtaggttagataaagcttagattaattaacagtagagcttaggcaacttttcttgctggagtacttacaaaaaaataaggggttcctgagagccacccagactgatgaaagatcagcctagctgcactttagactcacctgaagtctagacgctcagcttccagggattctggttccattaggctggggtagggcaacatgggtaattttaaaaagcttctcaggtgatttgtaagatgattagggtccaatcactggcccgggctcagggaatctgtattcaagctcccagatgattcctacatgcattaaagcttcaaaacccactggcttcctattaaactctccagctctgaaatcagacccaggttcaaatcctcatgtttttttgttttttttttttgaaatggagtcttggctctgtcgcccaggctggagtgcagtggcacaatctcggctcagtgcaagctccgcctcccgggttcacacaattgtcctgcctcagcttcccgaatagctgggactacaggcgcctgccaccacacccggctaattttttgtattttttagtagagagggggtttcaccgtgttagccaggatggtctcaatctcctgacctcgtgatctgcccgccctggcctcccaaagtgcgtgagccaccacacctggcctcaaatccttattcttgcactcactaccatattactttgagcaaggttcttacccgcttcttcacctacaaaatgacaataataacagtaccttccacagaagtgttcatggggattaagtaagatggaaataagttagcatactgtatgacatacagcaagtcccactaagtgataccttattaacatgctaaagcatttattgagcccttccttattgtggattagcattttatgtgtgtgtgtatatgagacatagtgactcatctccaggcctgtgactttgggctacttaacacctttgtgcatcaggagattataaacagcataaaagaagtaagtcatgaggattcaatgaaatattgcatgaaaagtgtttagtagagccctagtacatagtaaatgctcagtaaatgccagctgttataattgcacataatagtcaattttcaataaaagttgataattctggagtattcttaatacatttcctgtccaagaaaatacccagcttggctcctaagtaaagccaaagatctttcttgtgcttatttcttagattttgctataggggctggcccgcatcacgggtttaaggaaagttttctaaatgcacaaacgaatggattactagggaatttccacttgccttcaccctccacactgattttgcctgtgactcaagatcgtgaaagtcttcctgaccacggggccattcattccgtttccaaatgctgcaacccgcccatggctctaatcaagagcagaactgatttatgctggaagtggagtgagccagggaggtggaatcctccaccgctgatttgtttattgctgagtccttgaaaattgaatagggaggaaaagggaggtgtgagaaatgagttaagagctactccccatcacatttgataagaggttctttcactctggaagagtatagcttttcgttgttgttaatatgaaaatgctataagtgctacaaaaacacatgtcaagttccatgcctgtcttccacctgatggccaccaagagccctgacaatgatggaatagcaagctgcctggatttctagggcttaattaaggaactgtaacaggctatgctacaactctgtaatactccttggtaaatgactacagtagataaagaaaaattggtttcctccatttagcagatattgattacagggtttgttttaaaacatttagactaacttggttctttgttttatttattcacttccatgcattaattgaaagcccacggctcagattgtattaacttgatcgccctctactggccacatgctggagtacatgcctgtttttgacctatcctacaaaaactacagctatttttagaaagtattggccttttcaagtcaaacatactttttcaaggtcaattatgagtacggtggggagactcctgtatataaaaccccaaattgtctactctgtttttgaatattctgcttcctgaaagatctttcgattccatatatttgataatttaagaagaaccatgaccaggagccagaagatctgagttcacatgggcctaccctctcatctatgaaaggagaaggttgaggtaggacaggcacaaggcccctttttaatctctcaagctggggcggtagggactgcaccccatgttagaagccaggtgccctgcgatcgagtcctaatttgagatttagttctgattcccttttactcttgctataaagtgaataaggagggtatgaaatctccagggttcctttgaattccaatatgttaggactcaattcatactaacctcgagcacatataagtgacagggaggaattttcggaaagataattcctcttaaaacccctttaaaaggttattttttcttttttcctatgacaattttctagaaaacataggatttattcctcacaaagctccccatacttgtagctgaaactattgtctccacatgaacagtttgaataaactgtaacatttttattatctagaacataggagagaaaaaaatccaacaccagattctagatggagatttattgcagattcttataatttgggggggaaaataaaatgatgaggcccttcaagtccaagggagaaaagctggctctgagtccctaagcagaaacattttttaaaagctgctctacttccctccacaaagcagatctgcaatgtgatcggcaaccttttgcttccatcattttggtggattacccagtccctagacacagttcaaagaagacatttgctcaggtagggtgagcacagtgtaatcctccatccttgcaacaaacattaagagcatttaagaaagtcagagcaaggcaatgctggaagaacttcttttctactatgagaaaaagcagaaaatgccacatacaacaatgtaaaattgattgacttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttttatatatatatatatatatatatatatatataatatgtatatgatggaatactacccagccataaaaggaatgaattaacagcacttgcaataacctggatgagactggagactattactctaagtgaagtaactcaggaatcaaaaaccaaacattgtatgtcctcactgatatgtgggaaataagctgtgaggatgcaaagacataagaatgatgccatgggccaggcgcagtggctcacgcctgtaatcccagcacttcggaaggccaaggcaggcgaatcacgaggtcaggagttcgagaccagcctgaccaacatgctgaaaccccgtctctactaaaaatacaaaaaaaattagctgggcgtggtggtgtgtgcctgtaatcccagttacttaggatgctgaggcaggagaatcgcttgaacctgggaggtggaggttgcagtgagcaaagattgagccattgcactccagcctgggtgacagggggagactccgtctcaaaaaaaaaaaaaaaaaaaaaaaaaaaaagaatgatgcaatgagatttgaggacttcgggggaagagtgggagggcgcaagggataaaagataacaaatatggtgcagtgtatactgctcagtgatgggttcaccaaaatctcacaaatcaccactaaagaacttacccatgtaatcaaacaccaactgtaccccaacaagttatggagaaataaaataaaatactgaagtacaaactttttttaaaaaaaagtgaaaaacacaggatctgtatattaaattacaaattgctgatgaaagaaatcaaagagacctcaataaatggagacatccctactaggttcatggattggaggactcaacataataaagccatcaattctccccaaattaatctgtaagtttattacaacagcaacaaaaccaatactaggaagggagtcataggggcattacactcatgttgtagatgataattaagaagattatgtatcttccctacaaagaccaaatcccacagataatagtactattttctgatatttaaaattttgctctaagagattttcggagaaaacattcaagtccttctaaggatgctagggctgtatggatgcatacatgtgtatcttcttttccgaagggacaaaaaacaaaataaaccacatatttccaggggaaaaccaaagcaatagagtagagagaagaaatgtttgagtttgattctgcactaacttttccaaagcaagagttctattcagtgtgagtaccttccagaacaaggcactgtgtgggaaacatcgtagaaggctgtaatctttccccagatcatttcctggttggggaataaactattgcagattaatgcagattacattgtgttctctctgaggactgtagacaaaatagtggctattagtttctagggactggaaattaatagagagggagtttaatgcaagtcacattcaatcccatgagcaagtctttaaaatctatcaggtctagttcaaaaataggtctcacattccattattctctccatctccactattactatcttagatcagtggtccaaaagataggaacaggagcattgacagtgtgtttcatgactttcaggcagtcaatttcagagaaggcaatagcaaagaagaatcatgttcctttctgacttaaagaatttgagaccctgttcctattatctctggaatctagaggcatcacatcccatgcatcctctggcatcatgatcacagaagttttatctgcaacaggtgtatgaggagcttatataactgtgcatgctcataccctcctaatctcatccgcatgactattctgcaaacacaaagcataaaataccccagactagacaccggcatgagtccagctgaaaaaattgacagatcagcatggtctctgtataagcatgtgataaaatctctacagtcatgttttccaactgaatgctagctctccctcccctggatccccataacctttcttccattctctgataatagcttttcatttgctttctctgcctgttaaactgtaagttcctgtgggtagggagcaggtatgatcacgtgccttacttaactcagacagcaggataaaatgagtcctctggagtctcacagacctatcctggaaggccaactttactaactgtagggctttgggcccttaacctctctgagcctcaattccaataggaaaacagttattgtaagtatccaatgacatttatgcaaatggcttagccaatgcttgcccctagcaattgatgtgataaataataccactgtatcctaggttgggctctctagagttaatatttgagatggagatttgggtgtctgcgatttacctgaaggagaggtctcagaaagaaaggagttagggaagtaagacagagtcgggggaggagctaagctgaactctagcttcagcctgatcccacagggaggtctgaagcataaattgcaccaaaaggttggttccctcttgggatgggtccagccatttctatcctccccccattcaaaccctccatatccattggttactggctataggctgccttcctttgtgggcacagaaggacgtatcctccatggccaagcagctcccatggccaaggacagttccacgaagaatagggcagttgtgagctgacagtaacctatactcacagcaaccatgtaagggagatctgggaaaggcaccagaaacacccactacactattattatatttgtatcattctatgtccaaatatgagcttttgacatgacagggactcaataaatagttgaactaaattgaagaatctaaattgcatagactgtgcaaagccagcatgaatagcttttgtctcatccgcatattcaaaatctttggagacagctgtcacattcctccccttcactggccctcagaattgccaagactacacaaggttgtagcacacccctaaattcccaggcacactgattatgtatgacgctcacttaactgtaaattttcttgcttctcttgtttcagagattttctggtgctaattacacctacgcttacatccaaatatttcattgtgatgcagattatacttgtaagtgcatgaattattctttgaaggcaaaaggaattaataatgtttcaccattcactgtgacatgtttccaagcatgtaagtgacaggtgcacttttaaataatgtactttttcttctccttgacaagcaagaacccagatttaaagagatagaagatgtgaaggattgtcttgtggatctactgatgtcatgcttgggtttccatctccatcagcaaatgaacgaataagtaatgtatacaggtcccagtacctgctcagattagattgtatcagcagccttacactctgaaataccattaggacaaatccccaggcactcagggatagaaagagagagctgggttggtcatcagtaggaatggaggaaagctttttgtaaatcacaaggtgatttataaaggtcaattattagtattaattattctactatcaactttatgttcagtgctcctggctctacctacatctccttctgaattaatcagccccttccagagatttcacatctgttcaggtgactagggacaaataaaaaggagcctaaacaggttgaggaacctgctcttttcttgtacttttatctaatactctctctactggtagagactaaattgaattcagaaaacaaatctagcaggtggttctagagccttaattgtgagtggccaatagataacatataaaaggaaatggggattttatacatcatcatcaccctcatgaagtcaaggaaatgaatgcctaaagactagttgttgaatttcagaagattcatgtgtgtaaaacaagtggacctactgccccaattcaccagatttcattttagttctattaggatcatgaggtatttgagaaaagaagaaaaagaaaaaaaaaaaactcacaatttggtatgggcaatacaaaaagttctctctcacatgtattaatacatccactttaatggcaaaaacagactttaattttggaaaggaatatagctgagctctagattagaagcccataaactatggaccaaatctctcttctgcctgtctctgttagtaaagtttcattacaacacagccatgcccattcatttacatattgcctatgcttcttttaggataacaacagtggagctgaataggtgggaaaaagaccacgctggccacaatgccaaaaaatagttatatttggccctttatagaaaatgtttgctgactcttgctctacagccaaactccttgatattaaatactggttctatcacttattagctgtggtactttcagaaagtttctcaatgtaatcatcgtgaagaaatgaacactatctaccacttagggttgataggaagattgagtaagtttaaatatccaaagtgcctagaccagcatctagcatatattcaggattcaataactattagccattattattataaacagcaagaacaaatatccttctccccatacgcattgttggctctcatgccaaaagaaccacccagaggcccttctgccctttctcatggataagtttggaatgtctctccaatgttctgaatgcacatagatactttctaggtattctagttattctatagcagctgcgcagaagggaagccatttcttttcttttcctctctttattcttggaagatggcttcagttaaaaagctcaagcagagatttcaaacctccttcttctgtctaaaatatttaatggccagcctaacaaccctggcaaaacaactggtttgttttcacaactcacagtgttttttcatctttagaatcaattagaggttctaaagatattgtaggatcaaagattggcttagaatataaaccttgaattcctaagagagcttacaagtttgtccagattagatgctcaagatgaacagagggcccagcctctgtaaggtaggaatgtaaagtggggataaaattagtagaattttgaaaaacccacctttttgagaaatacagatgaataaatagattacacttctttctctctctctttcacttcctttccaccttttccttacggccaggttaataataaaaaggtcagtgttctgagttctaaaaaaaaatgtatactgatacccatatgcataaggcattgccctgggcaccatggagaaattcaatgtggtaaaattcccatcctagggagttaataatctgcttgagaaagcaagacaagcccatgaaaagttaaatagcaattaatgagttcaatgacagtacaagacaacagtggaaaagatactgctatgcaataagtaattagttgctaaattcagatagttaatattatagaaatttcaggggaaaataaaatccacatgatgtaaatttgttaaccaaaacacaagaaaatggccatcctacttcctcttactgaaggaagataaaaacactaaagttaaatatgtatttacatttcaagtgagtaatttgaggtgttttcatttaaaataaacattaattaactagcttcccaggctaacaatgtgtgttaatcagtcgctgaaccttgttttctaacaacttcagctgtaatgtgtaggttagaccaaaagattcagatggaaatcagaacaccaggaatggtgaagtcttagaagaaggcatgctcctgtagcaaaaacaggaggatgggatggggtcctgaacagcatcaaaaggcccacaagttgacagaacatagctgaatatcagagtagcctccccagagtcagtacgaatgaacaggcatggctgaattctaaaacattctagaaagattaagctaaaacatctacaagtgagtctcctgaatgaagcttctttatcatattcaccaattcactgcatccacccttatttcctagatgtttggggaagaggcttatatccagatatgccaccaaattcaaatttaactacaccctcagatttctgctccttttggaccactagagttcttattttggagcttgatgatctgcttgtataaactccgtaagcatagcagtaaagaatgtgactcccaaactaaactacctaggttccaatcccaatcccactgctgtgatctggagcaaattgcttatccatccactgagcctcagtttgcccagttgtaaatgggaaggatactagtattaaactcatacagttgtcattagggccaaatgtgctaatacatgtgaagctttttgaactatacatagtaaattccttataaatataagctggcataccctgtcactgctaagtaagagggcagaattagtaattcttttaattacttaacatgccagctatagaggcaacctgcctccttctctgggaccaacactggtcctacaaatggagctataacaagttggagtttatcaatttggtagtcttctttctggccttgtgtgtatcttaccccactccttccactaatacgacctaattataatattataattaattcaaaaattgtccttcttcctatcaggtcctggctccagactacctgtgtttctctggaaagagctattagtgttgaccaatgtcagtgattctaaaaactaagtcattgcatcccagccattctccatccactggggccccctaatgctatgctctgccactgatatatgcaggaggcagataaggaagggtccccagagaatttctgacctgccccacaagtgtttacaccagatgtttttgtgcagataagggaacctgcacagggtctttcctgggcatgcccacatgcactgaaggaatggagtggagccaccaggaattcacaccttatgcaggggaggagcctggcctcttcagctcctgtgtggtggcctggtattcaatctgcgaggtgggagcctattggcagggccccttctttctttgctgagagatttattttcgcctaatacaaccactttcctcacccttcaatgtgtctgtgtgcctaatttttcctggtcttgagacaagacctagattttagccaagctaaggagcaaaaaatcctgcatcattttggtggcccatatggggacctgaggaagggtgagtaaaatacggacctgaatgtttctttcccttttgttttggagccttcttgttctcagatttcttctaaaggtagaaaaaactgagacttgccttgtcactcttgggggtcaggaatgttggcctcagtccagcccagttttttctatggcaatttccttctttttattaggactgtaatggcagctatcttttcttttacatattggggggtgttccacccccaccccaatggccacaggtgcatgcacaggacagatgggtgagcagcagctccccgcccccctcccctctcggttggggctggggcacatggcccaagggccctgcgtggctggctggccagcattccctgccatgcaccgggagtcttcccctctcctggccaaggggtccacctcagtccaacagcaattaaaagtttctctcagctgggcacagtggctcacgcctgtaattccagcactttgggaggccgaggcaggcagatcacaaggtcaagagatcgagaccatcctggccaacatgatgaaactctgtctctactaaaaatacaaaaattatctgggtgtggtggtgcatgcctgtagtctcagctgcttgggaggctgagtcaggagaatcacttgaacctgggaggcggagattgcagtgagctgagattgggccactgcactccagcctggcaactcagcgagactctgtctcaaaaaaaaaaaaaaagtttctctccctgttggagaaacccatttacataagaataagaggttattcccccaggcatctttccagtcctgcacttaaactattattattttcttcttttttcaccctatcaggagttaacttttgtgtgagagatttttccttttagaaggtgtttttactaggccaggaccccaattcacaagatgctcttttctctcccttgttggaggggaacttggttccacagctttgccttaacattcagcttataaggagtccatgaaaccccatgagacacatttttgccccaaactccattccaagctttggaacttgaaggctactgacagcaggcgggacatggagttcatgggtaagagcagataatccctccctcaggcccccctattaacatgggtgaaagccacattgacactcatgggcagcaccctgtcatggccactgggattcgggaataaaaagatggaagaaggaaaaaggatgctttttccttctctcactcatatagcctgggtattcactaaaaagagaaagggaccaggggtgcctgttaccccttctagatgagtagccattcatctttagtctagttggcttggagttgagctcaggggaaaggaacccagaagcctgacatgctggcaaaagggtaaaagtttttaccagttgggcttttggcttccctctccctgtgcacaccagtaagaggaatgataagaatcactgtttatattatctgtgaagttctgattaatgaaaaaggatatatgaggttggtcttaagctgtagccaatctggtatgctttgcgtgtcttaattgaggtttgttggtcccactggtgaggttacttttgataaagttcaaaagctagatacatcagctgcttggcatggctaaagtgaactaataagggatttaaaaggattttcttaaagagagctcagcttaattagaagtgtatatccaagttataggtatatttaaaaggcctttatgtttttctcttcttgaatcttattttgctgaaaaaagggttttcctcagttgactgaattatttttctccattttgccttgccactcttaatgcatgcattagagcccctaagataatttctgatggcctgggactccttgggaaagacagaaaagacaccacggattccattttgggagaaacctctgttttcctcatggaagcccaggaattagaagcggataaatccctctcaaaatctgtttttgtcttccagctatacctgtttattgggccctggaaacagcatgctcttaaagggctccatcctgaggcaaataatccaattgggattgttgagattgggattttttttcttttttctccaccctgagaattgagattgacaaatgaaaaattttatagctactggatcttcttctgtctgtgtagttatatatgtgttgtgtgtgatgtctataaaaaagagctctaattaattggcttaaagaaaaataagcacttagatcaaacttagtcaaactttattgatgcctagcacataattaaaacaacttaccagattttacattacagttaaaaattcctaagagttaccactataacatgtaattgagaccactgaaaatggatttacatacaaggtgtgtaagaacagtaaaatgtgtttttagtaaaagattataagagggcatggaaatgtaaatttttgcctagggctaaagaattttttaaaattagataagataaagctaaaggtttaaacacattgtggaaggtttctaagaattaatcttgtaaaagaaattctgtgtttgcacattgacaaaattcaaaggggtattatatggttttaattcaaaagggtattatatggtttttctgcaaatggaacattgaagtaaaagcacaacaaggttttcttaaggcactaatctgctctttagcaaaatttgtagagggttataaaaggattataaggatctcacctggtggttaaactggttaagataagatagaattgtctgtaaagtttcattagaaaattgggatagacgttaatagtaagggtaaaattactattaatgtaagggtaaaatttggctttctctcccttgtacaagattttcacgtactagtaaaggataatgagcgattttcatttgccttgtggatagactgccaaggaaaagaaagagcagacaagagaaaaattttttggaaaacaaagtcttccctgttaatgagtaaagattttctgccttgttttaaaattcctaagtcatcgttttggcaaaataaataacttatggtaatctgaaattctattttatagcatcaagtgttttaaatttttaacatatttaacaggcttccctgaatcaaatttcagcttcaggttgtcttttctgacctcagcttttggatgctacagatggcccctggagcacccaaaagagaggtaaacaggattatttgacatgttgaggtacatgggattgccaaaatgatgtttaatcttcttcaggttataatttagggaataatattaatatatattccaaaattgtatgggatttctaaaattctaatgtttgggtatatgctatcaatcatgattaaggttgatattatgttaagttattgtaaaccacagagataaccaaatttctttgtcaatcgtgtttttgactgtaactaccctagaattttttttattcacaggcaattgttgtcttgttttgatcctgttcaaaagatggtttataatcagctatagaactttgacaggtactctcaaatgcagatttcttgtaattttggagattgtgacattggaataatgaattcatgaagagctgaaatgttcatgaatatcaaatagaacaagagttaatggaatggactgaactaatagaaaactgaagtagcctttttaaatgtttgcttagaacactgctgatccttgttttgtttttcagagtcaaggaaccttatgttcagctatttatggcctttaataattgaataaagtacaattctgtgacaaaatttggagcatatttgtttctctttgcctggtttctccagaatttggaaactagtcatgagtattcatgacttatggcagtattcatgacttatggcaaagtagttatttgtgtcagtgcaataagaatccattttcttttgcaacagaatgcaagtggagaaactggttgttttaccaaagctttgactggaagggtatgcatcccgttaaggaatcaagcttgacttgcagagctgataaaagtcccttgggaaaactggcctcacaccttgtattcacagtccctgtacagggttcctgacccatggtaagtaaagaatgttgctttctaacaagtccaggaatcacatgttcttggacctcaagaagagaggagtttatgcaactcaggtatttgagggtacaaactcatggctgggctcagctttaaaaaaaagaagaaaaagtcttatctcagattccttgtggaacagagttccatcaaagccaatctgaaaggcctatgtaaaaataattatttgtgctgtactttatgcaaataatcaggccaagtataagactaaagtctatttttcaaacaactcagtcccatcatgatttctttttgacaagaatgaggactggagagagataaattatgttccaaaacttagacatttgtcattaaattctagactcattagctgttttaattttttttcccccacattataagttaactctgattattcctgtgaaccaaccagtgatctccaactgcagctcagaagaaacaaaagagatgagtaatgtaaaaatctggatcaaatagtctagttctgggcaattaccttgcaaatcctggcaggtgataggagtaaatagggtgcccatcacccagaggtatcctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacatgttttccaataacccagtttgtctcttctggccttcaggccatcaaactccaaatactccaaatagtcctgccaccggagcctttgatgatcaccccttttaccagggacccttatataggcctatgagggagatctgattgctgattccccaaaacagcacccctgtcagcaggaagcagttaatattggtcttcatccttaaccttatccttatccttatccttatccttatccttatccttatccttatccttatccttatccttatctttaacctaagggcatttagatgtacttctaacctaagggcatttagatgtacttctttagtagggggaatgatagatgcaggaggcagataaggaagtgtccctggagaatctctgacctgccccacaagtgtttatgccagatgtctttgtgcagctgggggaacctgcacagggtcttgcctgggcatgcccacaagggactggtggcccatgtgcactgggtcaatggggtggagccaccaggaattcacgcctcatgcagggggagaaggctagcctcttcagctcatgtgtggtagcctggtattcgatctgtgaggtgggatcctgttggcaggacccactctttctttgctgagagcattcttttcacctgataaatctacctttctcacccttcaatgtgtctgcatatctaagttttccttgttgtgagacaaggacctggattttagctgaactaaggaggaaagaatcctgtatcattaccttctgagaacttgtttatggtaggactgctcaaatgatgactacatattaacctggataccttccactgttctgttgaaatcttcacccatcacttccctgcctccaagaatctgactggtttccatgtctttgccatatgtggtttggtgtctaatctacttaaatgctgtcagagttttccatatagcagatagcctcaaaaggctgaatcacctcctctcttgcagacgttatggcaaatacgctaagaaatccttccaagcactctcaaaggattcaccttctctgcctcatctctggttagttggtttgacaaaatgagaagacgagggtgacattcagaactccttgattctgctattattggcaaaactgtctcattagcattaaaatagggagaagacctaggttggaagggatattgcttaaaaaagaaaaaaaaagacttctgcttagcatgcaaactaaagcctaatacttagtatgtgctgcagaacagagttgctgaatagttctgccataaatcattctacaatgcttaggtatgtgaagctgtaaacccattccataattttcattagaaagagaccttcatttcaaaaaaaaagaattgcagcccctcagtagagatcctctggaaatcacataaaatggaaaaaaatgagggaatctctatctatctctaaacacacacacacacagatacacacacacacacacacacacaccagggcaaaatattaacttccaatcactgctagaaggcactaggtcaatcacagctcagaacacagtgaaaattgtgttacaaaagcaagcccgtctcccagacaatcctgcccctgctgcacacctgtgctgccttctcatccaatggcctccagaaacctgtaggcaagaagctgatcattaggagccttgacctactcactcgtccccaacctctggtgcatctctcagaatgtagcaattattatcctagcaccaacagcagcaaactaacatctcacccacaaatatacttcttactgcctttcatcgtgtagcaaatatccttttatgcacacctcaatcagaattacccaaacagccattaacacagcttggagagggagaagagtaagaaaaagttctaaaaccagacaaatcaactgcaaagtcaaatttgtattaagaacccacagatgctgggggctagttgatggaagttaggcaggtaaggcaaaatttaaggtgcattaaaaagctcagtgactgagatagataaattatattctaatgcaatacattttttaaaatagaagttaatacagataaattcattgtgaaccaaatatcaaaattttaaataataaaattcagcagtaccataatgagccattttaaagcctaagacaaaagagaaaatcagtgatgctgatcgtgttttcattaaatatttggatatttcattcatcatggattttttttgcatgaagtttgattttttaaaaatgttttattaaaatattacatatcttgatttaggagtttcctggtggcaccctcttaaatttgcacccaaggcaagctccttgcttatcccatgcttatccctgccctgctccaaattactgataattcttgtatcactagaaagaacaagtattgtcttctgatatagccttccataatattgctacccatcttatcttaaaaaatcagaggccccggaattagtacaagtggaatggagggcagatcctacttaagcattcttaaacagcttaaatacgcctcttgggttcaactgctatggcttttattcaagagaaactgtaattggaaagtcacaaatttaacattaacttttccatttctgctgtatgttgggtttagtttcacaaacaaggtccttttagatcagtaattcccaggctttataccatcaaagactctttttctccccacctgtaaccagggcttgtgttttgaaatactttttttttgccaaacatttatgaatgaatttatgcataaattctgtccaccatttaataggccaagatatctgaatttgccaatcatatattctgatcagtgggagatcacctatgattgccagagggaaccagcacaattgtgatcaaaggcggagatacttgacctgcaactcagcctgccaagcttcatcaaggatgccacaatttcattagatattttgaaatactgagttctcaaaaataattataatgaaatattaacttaaaagagtgacatgaaagaaatggtaggtataccatgttttcacctagctttataaaactgtaatgtaaaaaagtttggtatagtagtaacaggattacatatatatgtgtgtgtgtgtgtgtgtgtgtgtatgtgtgtatatatatggggtgtgtgtgtgtgtgtgtgtgtgtgacgttttcatttaaaagttgaaaaataatccagatctccattaccagctttctagttctttggggacctaaggacctcctatgtaggaaccattgttttgttgaaacaaatcagctatggcaaacaactgaaagagatctggtagagcaatgagtttctgagcaagtatgaatgaatacaaggcttataaatgtatggaaggaaagcagaccaagggacccaaagccattgatcgaagcctgacataattcattaagaaaataacatttccagaagtttttcaagattatctactagaatgtaagctctctgagttgcaggaaccacctgtgtggcctaatatcctgcagcgttctccctggacagactcaatgcatatttattgaataaataaatgaatgaggagttccttcttttatcaccattgttttaacatccgaataaactttaaaaggcatcaggattagaaaaccatattaagatagatatgggcatccaataggagcagacccttgggaccctgtttaaaaaaagcatcttgtcaagaacaatcattaagagacattataaagcacctcattcattcacacctgttggctaacaaatcaatgacatgttccacagatgcttcctcttggatttgtcccacttgaactctccaatatcttgttcaagatagtatacaaccttaaccacactcatttattcttcattttcactatggtgctccatcctgtatttcctgcctctccaacacactagtttaccctctctagtcctgcatttatcctctctccttcatcccatttcccacctacagaatttggtccagcatgggtaatttcttgcacactttttgagtgattcctcataacaattctatgaagaaggcaatgcaaaacttattattggtcccattctatggatggagaaattgaaggttagagatttaagagtgatgacctcagatttcagtaagtgatagatctgggattcagaaccaggtctcctttccccaggattctgttacattaccaaggacctcaacatggtatacagcatgcagttgctcaaagcctgacaaaatgaatgatataagtcatgtaagaaggttcagatgatactagagagctctatcttcctgtgcctatggaataaaaatataattctttagcatgatatataagatattcataatttggcttgtctgactttcctgcttttttctccatgactgctcattattcccacagtacccaaaccatgctaacctggcaggatcccttgtcctccaccttcatgcctctaagcctttgcctatgctgtttcatcctcaatgcctctcccaccttgttcacctagcaagttccaactcatccttctagaacctgttaagtatgacttaggaatctttctcactgaatgaggcttgctctcctctgtgcccacaacactgttacttcagcagcttccacagctctcaggataaggtccatatctttctacatggcagtcaaggcccttcatgatctagatcttgcttacatcttcagtgttttcttctcctatacctaccatgccctctgatgctattatctctccataatgaaatacttatggttttcacatacacatcactgtctgtctctcctcacagcttttgcacacacagctccctctgcctccctcatcacttttgctaggaaaatttcaacttggtgtttgtgaggtcttagctgacgtgtcacattcttctggaagcccgctgagtcagcgttggtgtcagtcttccttgctgcctgagtgcttccgccatcgtggtacctccttgctagtgtctcattgataagtacttagtgactgacttttccagtgctactgtagtgtgaaggatcccccatcaggttacttaagggtgtatatccactgcctgcatcttgacagccggctggttggtgagctgaggtcacggtgaccagccaaagagcaggtgtccctgagaacccaaacatcccagagtatctaagaacctatcaaggaaaacagtcccatcatgcatgcacagtaggcctaagagccagagaattagcttaaaagcagcttagaggtgggaagtggggcggatctctagaggtgccttcctgcctgccatccaggagtaccctatatgtaaatcttaactcatctgcttgccaagctgcacttgtccaaatcattcttcggtctcttgataccttcctagtttggggatgaaggtgtttttcccataacagttatccttatagttttttttcttctttaatatatttcctgcctttcccagaagagtctgtgatcagtttctcctttattttccttattgtagattcatttccatcttttcaggttccattcttcacagagtgcttccattgtttgggggtgactgatgtttgggggtgactgattgagggtgactgatgctattgtttgagggtgactgatgtggtggaaagaatgctggatggggtgctagctcaggctcaagtcctatccattcactcattcattcattctttcaacagctatttacagaatactttctacctaagtgctaggtactattctaggtgatgaagggaataagcaaagcccctgccctcaaaaggttttccagtaagggagttagaccagattaaaaaaagataatcacatatacaatgtaatatatactagtggtaagtgttatgtgaaaaaacattgctatgatattgctcatcctatcctggacaaacctgttaaagctctctgaaactaaatgttataaaataacattctaaaatggtgctaataatatctgctctaaataactagcaagggtggctatgaggctcacatatgaaagaatagaaatgcatttttgaaaacagatgaagtatatgcctttattgttattattttaattttgatgtaatgcagtgtctatttgccctttccaagagccaacacatgaattttaaaaaaatatccatcagtcatttagatgtttgaaaatgagcaaatgtctggctgacagcctcggtcttcatctgaatgtttggttaacctatctgcatggttggaaaagtcatgcgtttactgctgtgcccttgaaagcatcaatctctaggattattatttttttcttacactattgagataatggtaattttcctgtctaaatataaattttaaatgggcattttcatgcccactttgaaaaacaagctaagcaggactgtccatctcacataaatgttatttatatttctatgtagctcgtttttatttggggcatatgtgaattccaacaatgtgtaggagaatattaaatcattacccatgaaacttaggaatcaaatttaattttgcaactgtttgcaaaatttcaaaaaattgcagcatactttatgtagctttataaaggattaatacataaaaataaactaagcaatgccttttctatattacattttgctaaagaatgttttgatgtcaacttttttgaaagctgactagaagtgaggagagaatgtagcaaatagaggagagcactggcctctttacttatatatttgtatatttatttgcaattatacaataagatgtgaacacatgctcacaataattcagacagtaattaaaaggctcaagttccttttacctattctgttccctcatcataaccttaccccaaccatgaagtgattactgttatcaatttggtatgtatccttctagaatttttagtatgtaatcacaaacatatatatggattttacataaatagcacgctatacatattgtccagcaagtttgtttttgacatatgtcttggagactttaccatgtggggacatcgagttctagcatattctttttcactgtggcatagtattgtattacatggatccactacagtttacctaccccatttctggtgggtgggcttttgggctgtttctgatgtactatgctgtatatggttcccagcacacatgcatgcatatttctccagggtatacactgagaggtataattgtggcttcagaagtattcacttcctttcctccatttaaatttaaatagacactgcagacttgccctccaataatgaagtaacaatgtacacttccaccaacagaatccactccagttaagcatctctgtggtattctagggaggtagtcagttgggcagaagaggctggtgtcctctagctctctgagggttatgaacatacattcagtaggtaaatcccaagaggtgaaaggatctcagctggcaatggttctccccttttcatttcactagagtgaactcctttttaatgcttctttgtcctttcttatttcggtttttagctgaaataagatgtgacatgctcacaataattcagacagtacttaaaaggctagatctttgataacagatatcctgtgaacctgtgtttcacctgaccattaaaatcgttctttggaattaataacaactaccgttgattaactgacacacactttggatgtactatctcaatacatcctcaaaatacatcctcagaataactctgtaagataggtattgctttgatctacatttttcaaatgagtacacaaagaggtatgtaaatctacccagggacataagggctattaagacatagagcagaaatctgaatctgggctgggtggtttccaaccccagttctggggctatgagccactgggctctactgcaagcaatcattcccttctctgctctcctaagcctgtttatctctgcctcccttgcatcaggcattgctttctaccttttattagttatttgtcaataggatttatcttatcttttagcctgttagcttctcaactgaaaaatgcatggatgagtcacctctgtctccaagaccatttcaaaaaatacagtacctcaaacacagtaggaacttgataaatatatcttgaaagaaagatgtacttaccactcagcttcacaaaacttctcccttacaatccaagatcactgactgtccccctgctgaatctgacaatggccttcatgggtcgtccactgtggcatcttttcaggaggtaattctcatatcagaacttctagatacgaatggcttctaatcctatctctaccactgagaaccattttctttatggcccattctcacacgacaccactgatgcaggatctgatgtcttcatgtgagttaatttatctgatacgttaattagaattaatttgccttaattgatcaattggagacattcatatcttgcagcccttcacttctaaaccctgttttctaactttccctcccagacctcttcttctagcatttaaccccagattttagtcttttgggcatgcctttattctgctttccagctcagctgctgagggaaatcctgatttgactgcctggcttccatggcagctaaacatctggatactatcttttgaatcaccttccaattcatgctctaattcccatgggtgaatcacaccctacccatgactaaggcaaatcctcactatttcagttagacccagcatcttgagttcctgtttattcgaatggtaactgaaataacatataacaaacactgtaacaaggactatcagtgttctattgaaagaagtggccctcgtgtaaagaagactaagccaccactttctcctctacctctctgtagcctactcatcctgaaagccatagtccatgttgccttcctcaactgtccccaacagttattaggatacttattaacttctgatattcatcaaccaaactagcatttaattatatatggtcttatattgttttatgtgatctatcatctcccttattaagcaaaaagcttcttgtagcagggaacaaacatattgccatactctcctttatcatcattgtcctcttcaccattgcaaatattttctttaacttattgagtgcagaatgctttacatgaattaattcatttaatcttcacaagaacactatgaggtagatgccattgctatcctcgttatggatatgagaaaactgagcacagagaggataagtaacttgcttaagatcacatggatatactatgtggtgaatcaggtatttgaatcttggcagcctggttctagaatctaagagcttaaccagtgagactttctttcatgtgatccttttatagtaccaaaaacagctgagaacgtacatagtactaaatagtaataaataagtacaaagtaagtactcattagatgcctaatttacagtttgatgcccatgggcttttcagtgtccttgagtcctctctatcatcatctcaagactcaactgcatatagttcaactacttaacataggcctggacacagggaaggggtcagactggaacaagatttgttgacaattctgcacagaaaaggaaacagtcaacagaataaagacaacaccagtagaatggaagaaaatatatgcaaaccagatatttgataaggggttaatatccaaaatatacaagaaactcaatagtaataaaacaactcactttaaaaatagccaaaggacctgaatagacgtttttcaaaagaaagcatataaagagctaacaggtataagaaaaaatgctcaacatcactaatcattagtgaaatgaaataaaaatttaaaccacaatgagatatcaccttattcatgttagaatgtctcttaataaaaagatgaaagataacaagtgttggtgaggatatggagaaaagggatcccttgtgcactgttggtgagaatgcaaattaatacagccattaagaaaaaaagtatggtggttcctcaaaaaatttaaaatagtactaacatatgacccagcaatcccacttctaggtgtatatccagagtatatgggatcagaggttgaagagatatctacattctcatgtttactgcagcactgttcacagtagctaaaacatggaatccatctaaatgtccatcaattgatgaatgaataaagaaatgtggtatacacacaaatagaatactatccagccttaaaatagaaggaaactctgtcatttgcaacaccatgtataaacctagagaacactacattaattgaaataagtcagaaaaagacaaatatcgcattatctcacttatatgtggaacgtaataaagttgaactcatagaagcagagaatagaatggtggttactagcgactagatggtgcagggttggggagatggcggtcaaaggatatacatgtctttttttcttctttctttctttttttttgagatggggtcttgccctgttgcccaggctggagttcagtggcactatcatagttcactaaagcctcagactcttgggctcaagtgatccttccacctcagcctcctgagtagctgtgacaacaggcacacaccaccaaaggatataaatttcagttagacagcaggaatcagttcaagagatctattgtacaccatggtgactatagtgaataactatgtattgtatactcgaaaattgctaaaggagtagattctaagtgttttttaaaaataagaatgtgaggtaatacatatgtataattagcttgatttatctatcccacaatgtatacataaatcaaaacacaatattacatatgataaatatatactatatttatttttattttatttttttttagactataaacataaatattattgtttggcattaccccaaagttcccctttaaaaaaacaaataaatggaaataatatatatttgagtgttctgtctctactttctttgaaccaaggaggcctcatactttatgagtttgttccaccctcttctaatatatctgtcaacagagcatggcaacagtgttacaaaatttaatgttttaaaattttgaacaaattaaaaacatgaaatttatatttctcttacattttactattctctaatgagggaaaatgatttaaattttggactaaatgcaaccagcatataaaataattctcttctgagtgatagtgaaacaattactgaattacaactatatgcagaaagtatttttgcctaacatgttttccatgtgactaacattatagctcattgcaagtggtttatttgttttataattaataaagaagtccaggtggagtttaacacaaaaacagaagatagagagcatttaattttgtagagagctttcagtactaaaataggtagtcagaattttctgactttaatggagtcagaaactgggtaactttcattcttttaacttaaatcagtttctggatttagtttatcaaaatagactatattgtatgtgtattggtgaactagaaatagatcagctctcaagaaaatgtggcacatatacaccatgaaatactatgcagccataaaaaatgatgagttcatgtcctttgtagggatatggatgaaattggaaatcatcattctcagtaaactatagctaggacaaaaaaccaaacactgcatgttctcactcatagatgggaattgaaaaatgagaacacatggacacaggaaggggaacatcacattctggggactgttgtggggtgggggaaagggggagggatagcattaggagatatacctaatgctaaatgatgagttaatgggtacagcacaccagcatagcacatgtatacatagcacatgtatacatgtatacatagggcacattatgtacatgtaccctaaaacttaaagtataataataataaaaaaagaaatactatttttatttttaaattaaaaaaattaaaacagcttgtccccaagagctgtggaagcaatggagaggcagactcagaggaagacgctgcaagagagatggtttgactggagaggcactgagcatgacaacaacaggatatggtccagatgtggcagacagtaaagcacatggggggctaagaaaatggactttgaaagaggactgcctaaactggaatcccagtgccacagagtgctactcatggaactgttgtgagctatgtgagtcaattcttctaaagtactaagcacagtaaaggagaaaggtgtgctgtacctgttaactgctatattattctgaataattagaatgaagaccaatatctgacttctgggtttctgacttatatgtggggcacagcaacagggaatgaaggcacagtgaacatgcagaattcagcatctttcctcaggctctggccatctgagcacacttggttttagtgaagttagcttataggcagttctagaaacaaatttagggaggatttggggccctaagcctagagattccaaggtccttgtataggttaacacaatagaaatgcatgtaccaggtacagaagagagggccctcatcaggactggggtacaaactggggacttggtccagacacaggtgacatctcgtggctcaaccgaggcacaggaccacagtgagacaacagcaagggtaccttggagcagagcctaatatatggggtggaattacagggcttaaatcagtgctacctcttctcaggagtagcgcagaggaccatgggcaggctgagtatgcagataaggattatatgactccaaaggtaaggaaaagctgggagttgggctggacctaatccatgttgcatggagctgcttcactgccctgtctgggcctcaccttcttggtgagcaagcaatctggtaccatgccctttggtgaaatcaggcatggaacaggtgactgaccttggggaacgaaagccaagctgccattcatcacagcccatggtgcaaacctctaaggtaagccttggagcctccagcgccccagcggtggggcatccgtcctctgggcagggagcttcaattcacacagcaggagagccataacatagcaggagacacacagaaggcctttaaatgtctattttttaaagtggttagcaaagcaggagagaaactgtcagagatccgcaatgcagagtttaatctggaaagtcagtgaagaggtggaaggaaacagaaaacaggagactggaagaagaggcttcaggatttggggagagcaaagcaaaaagtgttaacaagaaaaaaaaaacagttgcatatcagaaactgctcaattctcatgtcaacatttacagaacactgttttccatttttccgactgctctatgcatttgacaaatttttacttgttcttaattctagctcaaagttcacctcctttagacaaagccataccctcttctggcctctgttttaatagatacaatgtttgtaatagcatatttcaaaatattgtgtaatgaattgtgactctggatattatagccactcatcattttcttgaggatatttatccttatatccccaggacttagtaaagttcctggcacatattagctaatggtcaattaatggtcacttaatgaatagaagattaatgaatgaagaaggaaccaaggagggaagatgctttatgactgtacagggtgcatgcgaggggaggcaggaagtgagatctataaaggtgtcttagcatatcatgctggtgatgtgagccaagctaagcattgcagctttcatccactggcaaggtagcataataaaaggctgtaaagcagaatgtttcaaagagctgttcccccagtgccatcttcactctatacgttattaatctcatttcttccctacttcgaactaatgtgctcacattcaaagatttggcatatatagacccattcaaaacaaaatgtttcaagttctccagaaaataatcctaaacctcaacttcttcaagaaataatcctaaaataacctcccatcagcttctttgttactcagtattttattcttaacttattgtaaccttgtacctatttatttgtcccttgggagatgatggttttctttaagagttatgagtgtactttctagtgccaaacttgggttcaaagcctagctcatccacccacaagctttctgtctttaactaaattatttaatatcactgagtctcagtctgttcacctctataggcatgataaataatgcctacccacatgatttcggtaagaattgaaggctattgtaaagtttaaacatgaactaaacaatcaataccagcagctagtaatagtggttctgccaatattagttaaaaataataataatagtaagtttgttcttatgccctggcatactctctgggagaaagaatcatcttctctttcttaggttattatttctttttctctcccctcctacaactgcacatctgcctcttcccttcacagtattttgcaattctctgtgtgactcaaagcagagctcaggttatgcatgacagctgcctcttccactgtgccctggcaccatggatgtcactgccatcctccaccccatgcatgagccagaaccctgggctccttctgactcaccattctccctcacccccaccatacacagttcatcaggctctgtgaatccacatcctgaacggctcctgatgctggccattgctctccatgtgtgccatcaccttcaacaggttacctgcatctccaacccagactgccaccagagcctcctgactgccctcctgaggtcgcctgtgagaaataaaaatggaatcctaagccccccaactgaatggaccctctattggccaaggggaccccagattaaccttaaaaattgagttctcagccatgacaggatgagaggtcagacatgcctcagtatatccctccctcgctaaccatgttaggctttcctccctaagggataaacagaaactagctctttggaaagactccacttttgataccaacaaaccacctgatgctgcccctcctttttttgcctgagaaaagaccactgaccatgcagtggttctggccagtctatggagaatgtgcagtaaaggcttttgtgtcctctgcttcaccttttgacatcagagagctcaaaactccacccttggatcatgctaatgctaccattttttttgtacatgggacccacaaatgggcatgaagttcaattgcacaggaccacgtttctcctttcatgaatattcatgactcctcctatagcttattaaatatgtatatttggccaccttgctcagcgcacgttcctattccctttacctctcccttgaagtgtctgtttctagcttctggcaagaggctatgcttcctagcctgtgggaatgggcaccctgcaggctgcaacactttatgagaaataaagctgttttcccaaatttatgaatcttgtcattcttcagttgatacttgtctccctctctgcttctcattactgctcaattctccactctgtagctggaggggtcttcttaaagcataactacgatcatgtgaaacccccaccctaaggccctctcctggcttccccattgctcttagcatacacatccaagttgttaaacatggctgtttaataatcatgcttattatctgtgctggagccacactgactttatatcaggtcccctctttgcataggctgctattgtttcctccaataagctctccaaataaataagccttgcataatactgcttaaaaccaaagttaagtcctgaactctgaactaggaaggtctctttttagttcaggatactgtatgtcactgatataaagcactgtgtggagacaagtctcagagaaaaagacgaggctggcagaatataagagaaagtgacggatggaggaactggatgcctaaaagcacttcatttcacttttctaaatgtgccctgtcaaaatgaagggagcagacccagtaaggctgaagttagtggttgcacaataaagtagaatatttatcttcgctctggagctgcagaccattagcattagaaaacaccaccaagtctgtctcctaacatgcctggggccctcggaatggggaggatcctgatttaatgagcaagttacaccatctgtcaacaggacggctgagaggtaattcagccaacagcagctcccagaatttaaggagcaaaacacttgtgtgctatttgtgtaagacatggcccctagcttcacggtcaaggaatcctacgcaccctaactactcaagctgggagtgaggggtggtatctgtgtgtcttgctcacagtccagccagcttcagcttttttgtgtgggtgcttgatgagctttgcagaagggagacatccagctagaaatagggtcctggagagttccctctgcccccctttctgagcctaataatttctggcaagaggctacaacacgtattaacataaacaatatcactggccaaagtattcacactgttatggatggaaggaaggaggtgacagaagagagtatatttcatgtatattccttgtgagacacgattttgaaatggaaataatctaagagaataaattttgcacctagattagtgaaagcaacatggagttgctttggaaaatacctcagttgtaaaataatgtgatcttttactaaatgaactggtaattaatatcaaaatgaggaattttttccctgtaaaaattagtcaacttggaaatctatataaattcttcttctgtatttctatagctcattttataatacttattaaattttgaagtttacggatgtggggattttttttttttcacacacacttgtgagtccctaggccagagcttggcacacagggaggtagggtggcaaaagtgtatggacccaaaagtcaaataacaggaaattcaaatcccagctctcttacctagcagtatgaatttggtcatatttcctaagcctcagcttcctcatctgcagaatggggagaacaactatccatttctccagggttgatgtgacaattaaatgaaataaataatataaaatattactattatctgtaacacacaggaatcactcaataaatattgactactgttagatattcaagtgaaaatattcatttcagcataatgcttttatgcataaattgttgtgaaatcatcttgacatcctaactcccattgttcaaaacaaacaatataaatttgggtaggatttgatatgaagagacaactgaaaatcagttaaatataagcctggtatctatgaacttcttgactgtcagctttgagtcttactctcttattctcctttgaagctataatatctttcacagtgcttggcactcagctccagaagctataatatctttcacagtgcttggcactcagctccagtaaatatttatttaataaatggaacatttgttgaataaatcacggggtgaataaagtgggtgaacaatctgaacaatcacaagcaattttacttagcttgtttacccaacctagctttaggaatctattagaatgctatcaaaaagtagagagcactggatgcgggaaatattaataatttttctagctttccttcaccacagctgtggtggacatttgtcatgctccctggactgtcatcacattctgaatacctatcctatgtgcatcagtttcccattgctgctgtaacaaattactacacatttagtagcttaaaacaacacaaatgtattatcttacagttctggagctcagaaatctgaaatgaatcttaaggggctaaaatcaaggtgtcagcaggcatgtgttctttcttgaggctccagggaagaattaatttccttgtcttttccagctactggggatcttttgcatttctggtaactcccttccttcctcttcaaagcacatcaatccaacctcagcttctgttctcacatcttctttttctgactctgatcattctgcccctcttttataatgacttttgtgattacatttggcccacccagataatctaggataatctcccaatctcaagatctttaatcatgaatgctaaatcccttttaccatgtaaaataaacatattcataggttcctggcattagaattaggacacaaacatctttgggaggctattcttcagccaactcactatatttggagtatttcctgccttttgtatccagtcccacccaggtagaaacctgtactttactttggacaggatgcaggcatgtgactgaacttagtcattcagatgcctgagattatggttctaaagtgaacagcatgagcaagcaggtttgatatcaaatccatcttctggtgaggttggtagcagcagtgtccagctttctggataccaatggtgtatagagctcagtccacaccagtgatgagatctggctgtttctacacagcagtggcaggagtctttttttagagcaatgccataatatacccttgtaagtacaatttccaattactattttttggcctaccctcagactctgtgagcacctcaagtgctttaataaaaaattttttctgcttatagtagtcctgaaggtttcattatttataactaaggaacccagtggacacagcctcctgtgctaggttgtaagaagcgcttgcagggaggctgacggagtgctcctagaaaattggaacagcagacaatcatttggggcaccatttaggtgccaagtacttagtaaaaaaggccctgaagaaatggaatgcaatcattcaaactaggagttggtaaattgcgctgttctttataatacccggtgtagggggaggagagaaagagaatatcctatggaggtctgttctgagactttgatcttcatctcttctcaatatgacagaccaattcagatagaattctgtttgtgaaggaacagcaagagagattttgattactgattctggtcagcatggatgcacccctcagtgattttcaaagcactttatggcctttagttgtttacattaaattaaatagtcttggatatccattagtttagaaagcaaaattatatctggcttaaaactgctttttgcctactgcctcattcgcctctgcattatctagaacttgctcacatatggctcttactttatccatctgtaagacaaggtgatttttttttttttttcgaaataatgcatttccatccctctctgttcggtgtcttttgcttgcagtttggagagcttggttcaaatcctaactctagcagttagtagctgggtgacttgaactagttacttaacctctctgagcttcctttttctacaaaatgttgataatatactcccaaacagacttgtagtgaagattgaataagtatgtgatatggtggctgagctcagactctggattcagacaggtccacattcaaatcttagcttacatcttaacagctgtgtgctcctcagtgttacctgggtgcctgtctcctctcaatagaatcagagatggataagaagtccctcatagggttagagataaaatgagataataaatggacagcactttgcacagtgcctgttaggttctaatattatgaacagttaagtggctgtttggagtgggtgtttggagtgaattaaggaattatcaaacgaaagaataaaatcaacttcatgttttcaaacacccccaccaccaccttctctcaacacggtctctagtgatctgaaatcctttctaaataattgtttaaaagttgttaccactaacagagatcagatctgtggttgcctgcacaaggattggagagggactgactacaaagaaacatacagaaatttggggagtgataaaaatgttccacatcttagttgcggtggtggttataggactgtcttttttaccccaaactcatcaaaccatataattaaaatgagtgcattttatgtttaatgtacttcaataaaagtttatattaattaatgtattatgcttctagagcaagggttagcaaacatttttctgggaagggacagatagaaagtaatttgagctttgccggccttaggctctgttgcagctactcaactttgcccctacggtgtaaatgtagccatcgaaaatagatactagacagtacataaatgaatgagtgtggttgttttcaatcaaacacaattcatgaaccaaaatttgttttcatataattttcatgtgtcatgaaatatattatttcctcttttgatttttttccccaactatctgaaaatgtaacaaccattcttagcccctgggccttacaaagacaaggcagtaggctggatttggtcagtgggccactgtttgtcagcccctgctctagagttccaaagaggctttgttacgcagcgttatgaaatctgctttagggacttagtgcaaataccatgtctaagaggactgggagtccagctcctgtgagccctgtagggtctttgccagaacccactctctctgtggccagcctaagccgctgcttcttgacttcaattttgccatctgtgcagagaggacaacaatcatctctcagagcctggtaaagctcattcagcttgttatttgagagaaaatgctctaccaagtgcagaagctgatcatggcctgggttatgagtctggcctgtctcaatcatcagggggaaagtttgatttctcaggttgtcattcctaaaattgcttgttctccaggtgatgttcttatttctgaatatggtctgaccttcattccccaaagagaagggttatgttttcaaagagctggcagaagaagagtactcagaaagcttgctccttccctgccgaactgccatcccagcacaaaccatgccttaggggagggtgactttcccccataatgtttacctggatgggaccagagctactctaagctcctctgagagcaaagggagctttataaatgcaaaccagcacaaactgaggtttcttgtttttggtttctgacagtagaaggtgcttgaagcattactttggggtagtaaaatggccaaggtatccacaaaagtcaagacagttctgaggttcttgaagcttccgagcttttaaaaattgactattacatgtaaaattcaatcaatcccttactgaagaaaaaatcattattcaggtacccagtttatcctcctacctgttggaagcatttgattcaactgtttctcagaaatgtttttttgtaaagaggcagagaatacatgttttaggctttgcaggcagtatggtctctgttgcaactactcaatgctgctgctgtgatgtaaaagaagccctagacaatacatcaatgaatgagcatgactgtgtcccagtacaactttgttttctaagttgtaaacaaacaggttgtgggctggatttagtccacaggctgttgtttgctgagctctggtctgagttgtgttatatctagaagggacttggtggtttagggaagagaaaaaaacctaaatcagcagagactactggtgagaatgtggaaaaacctatcattacggattggagagtaaaacccaaccaatgagcatgttgcattaggagtaggatggggataccctagatgaatcctggccatggtgaattttcctgatgaaagtagaaaggcagccagtggatgggcagcaccggggacaagaagagccgatggggcattatggggagatactgctgctggctggactgctcataacagtgttcacaaagaagcctctggttgaacatgtgagaacctatgagtaagccatgtaggattcaggtgggtcaaaataaggtaaaaaccacagcatgagcaaaagcacaggtaagtgtctgcaaggtgccttcacagaatcctgagttggaaattggagcaaagttggaaaggtcagtctatggcacatcatggaagactttaaaacatcactttcaacagtgtgaactcttcatttttaagagtcagtgacaggtactgaaggtttctgagcttgtagtaccatatcccctacaaagcagctaactcaaatagtcttcctcctttacaaagagactatggttggctgcatctcacatgttatgaatttgatgctaataccagatcacatttattaagccattattatgtgcctgataatactgtactaaatgctttactttcatatgtcatttaataatgcttataaaaaatcactgatggggttattttttttgaaaatacttggaaaatggtttaatgatgttttacaacagaaatgaactgtacagttatggtaagtttaatatatatataaaattacagcagacaaatgcatctacacaaaatctaccatttcattctgattcactgtcacctacacaatctttcccaagcctacaacccctgcaggcagccctaggagggggaatcatctaaagggcacattgagagagacagcaccgctcatattcctcacaacctcctcaggcctcaggagctgatggggttatttttatctccattttacagattagaaaactgagatccataagaagttaacttacccaaagccaaccagcttgtaagaggcagagtgtgggtttaaatgcagctcttaatcattctcaactcaagctatatggcatctcagtggatttaaacatatttctgcattttaatagttaaataaaatacttttaacatcatttctaaattgtttctccagtgttccctctcctcaaagatctccaatactataattacatttgtcatccttttatcttcctatgaattattttttaagatcaccagattaataataaaatatttgtaaatttaaattttgttcaaatttaatacaatcccagtgcactgctttagtattaaatcttgatttccatcaatgacatatctatccatctatgtatataattattttcacattatttgggctatattttaggaggatgttgctttaatgaacacaaaccatatatttatctgacatgaatttttggccacacacaataatgtgatataattttaaataagtaaaaaatgcttatataagtaaaagcttagaaagaaacaaaccagaatattaataatagttgtattatggttatgtgattataagtgatctgttttttctcttttttcccaattattttaaattggattatgttagtgttaaatttttaaaatataatcatgtgaaaaatgttctttttaaaaaaagagaggttataaaataatccagtgggaactaatcagcaactaatgaaataatgcccaaatgcaaaaagtgatgatgttccatgaaggttccatgtacttaaagctactggatctcattaaatcactgggacctaaaatcaggctggctggggtgggtctacactcagcttctctaagtacaatcaatttaagagaaacaggagtaggggtttagtggattagtcacagcaggccattaatctctgcattctcagttgtaatccagcctctaccaacgagcttggaggaaaaaaatcccacaaaaaaaccaaacactgggaaaagctctaaagcaggctccctagagacagacatactcaggtcacagtttgcttgtctttacttaacatcaatacagtatttatcatctgtcctatttcttgttggtttcccttttatgccttttgctgaaatgctcagatcagatatatttgaaaaggaaccatactgcaatctcaggaatagctcagcatttaattatcatttaaagaaatccttctctcaagtgaatatgaaacaaatcaaagctatgttttcatgttgagaataggttgaaaaaaacatgggtaaggttaccacaaacacaaattagtgcttggggaagcaggtaagtctgaacaatgaaaagggaatagagtagccaaatttcagtaaaaatgagtgacagtttcaaaaattgcagggtaaatagtgtatcttttatcataaatggattaggccataataatacctcacttctttattgctctggcaaatgatctagaatttactaatgtattaagtgggaaaaaataataagcaaattcctgagccagggttctatttatgccactactgtcaaggccgaatatttattggattatatgagaccatatgcctacattagaggttttgataaatttaaagtgcagttgtaaactaaaaatatggggcattaatttcttaatttttaaaaaattattaaaggaacatatgggcaagacccagtaaactgtctctgaagatgatgctatgaaaagacatgattatctcccttcttattacctttaaaatattccccaaacattctagtttcccctagtgaatcagattcaaccaaccttaactgattatgtgctatgtgcagacattgtgctgaacactttcacatgcattggctcatttaatccccatgttttacatgatattgccaaattccttcctaattttgctcaacgtgtcttttattcttttagcttcagccatatcgaaagcaaaagccaccatttatcaagtgcattctatatgccaaacaccaggctccattttttttatttcaagcccgcttaactccaaaaataggtgttattgcctccaatttacaaatgaggatactgacacttagttagagatattaaataacttcctaaagtcacacaataagaaacatcagagttgaggttaaatagtaagataaggtataacgtataatgttttcgatgaatgctcttcaatacatctgtagcagtcaatgacgacccctagactctttcccagcgttgcactagagggtgacaaggtaatcattccacaaatgttatttgggttatttttctcataatgccttatcatatgattgcccatatagaaagtcattttccactttttgttcactcacagtcgtgaaagatcttcctatattttcatcttgttgcctcaacatttcaaaaactggggaagtttagcatgaacagcaaatttggacaactttctgtaaaagtctcttaatatactaaagttcctaagttggaaagggatctagaaactacttagtccaatatgcttaaactgtttaaaaggagaaaactggccccagaatagtaaaattaattcctccatgccacagaagtagtagtggcaaaactaacactaaacacaacatgtcctaacttccatcctagtaatctcttgagcaaatcacctaattctatcttccctataatgtataaaaatgtgctccaagaacaatacttaagaaggcttaaaattctagacctagaaaaggtatttgtttatcttaaccacagtttcctgtctctgatctaacttgttatgcaaaataacatcttgaatcccatagctatttaggtttgtttaatagattttgaggtaaaccattgctgaaaggatgtttgaaagattagtcactattctacatacttgcttactctctcaaggaattcaagcacattactagagcctcataaacaggttatacattactttcagatataatacagtaaaatggtaaggaacttcatactgtttgacccaataatcacaatattgagattatttttaaaaaaaattcgataaatatctacttggataaaaacaaatgccaaaaaatgtcataaactagaaacaacatatatgcttaaaaacaagggaaagttaaatataaataatgctattttacatgaataaactactatggaaatataagaaaaaaataatgcatattgaagtagcagatactagctaattgttcgcaaaccattttccctttgctcctggctacaaggctagcctacaactctctaactgctttaaaataagatgttaacaggtgcaacacaccaacatggcacatgtatacatatgtaacaaacctgcatgttgtgcacatgtaccctagaacttaaagtatgataataaaaaaaaaataagatgtggctggctgggcactttggttcacgcctgtaatcccaccactttgggaggccaaggcaggaggatcacttgaggttgggagttttagaccagcctgaccaatgtggtgaaacaccatggtaaaaaaataaaaataggccgggcgcggtggctcacgcctgtaatcccagcactttgggaggctgaggcgggcggatcatgaggtcaggagatagagaccatcctggctaacacagtgaaaccccgcctctactaaaaatacaaaaaatcagccggccgtggtggcgggcgcctgtagtcccagctactcgggaggctgaggcaggagaatggcgtgaacccaggaggcggagcttgcagtgagccgagatcccaccgacagagcgagactccgtctcaaaataaataaataaataaataaataaatataaaaaaataaaaataaaaataagatgtggcaatgtgactgaccagaaaggatgcccacagcttttcttcttggcccacaaaaacccctcccatggtcttcctctacactttttttccccatctggtgatgttgatgcccaggaaaactttggaaaccataggaggtagcacagcccccatcaaccttgtgactcccaagtcaccactaaatacagaattttttttcttttatctctttcctctcaccaagcacctacatgcccacacacatacattgacatctattggacaattaatgcaaagaagtaagcctccattgtgttatgtcactgagattgtggggtgtatgtgtcagggtccaggatatgctgaactgacacaactaggaagcaacatggagaaatatttaagatataaagtttctttttacagtacaaattggaaaagttacagtttcaaaatttagtaaacaaaaatttggtctatggggaataatttttttcctaatttttttcataatattttatcatatttggcataaaatacactctgattccaggcttcactcatgtctgtgacactaaaacactttgcatatacagtccctgtcttgcaaggagcactgatcaagaaagaacatctgagttggatacgtaattggcctaaacaaccaaggcataaacacaactctcattcatgaagttgttcaacttgtctttggatgtggcacattatatgcctttacctggcttagtcaagctctaatttaagcagttctaaaagcagatttaaaaaaaaaaaaaaagcctgcactaacttatacacttaaaattgcatgtggctctcattcaaccaataaaactcagtgctaaaacaaactaaaaggccacaaggaacttcaccacagtagaaaaacaggaatgaaacttgttacagaaataaaacataatgacttcactactttatattccactctacaggggtttgagtcactgtaacttaagagccagtatcattatggtgcattacaagacttagacatcaagtgacatatttctatcacacccaggtcatacaatagaaacttgatactcaccgatgtctcactttaaaatccccaaacatccactgagaaattaacaatagggccccttttttttctataacccctttttatttttttctgtaattaagattacaagcaaacaacaacaaattatccaattgaccatctcctcacagttgtaaagattaaccaggtgattacagggtgaattcacagccaaggacagcaaatccactctgttctttcaattcctaggctgccagctcttctctggtaagaactagtcagctacaccacaattctgttacaaaaggccagaggggaagtaatgttttctgacacaagactgaaaacaccatagagaccacagtaatttcctgtattgctctgcatcaagactaaaaagtggggtaggctattctccctaaagcactctagttcaacacactaacaagggaacagtgagctttctaaagtgttgttttctcccaagtaggaacttggtaagaaatagcgtacatgttccaaacaatctcctcaagtaggaacagagatgacatggagaaaagaatgacaatgtatccactgatctttaattgtcctagttcaagcctttggtatggtgtcataaatacaaaagggccgaaatacattttaaacaactataagtgccccaaataaggatgatttgtcaaatggaaatatgagtcagagcaggactagaaaactatcaaacatattgctcattgggaaggttcccattctctgtgactctgcacactcaaaaacctacatgcagtagaagcaagacaacagctggtagaggtgtcttcttcatctcccctccctcatggcctcagatcttgtccctcagtctgccctgaatgcagaaaagccactctccatcgctccttattattcatttatgtattaattcagtcattcattattgagcattttctaaatgccaggcactgggttgggtaatgggaaaaaaaacactcacacatttgtgtgtcactacacacattttatagggcaaagaccattgctgttttttttactacattttatcttatgcctggcccagtgcccacctcataggaggcatttgttagcatttgtgcaataaattaacaaatacatttaacactgggaaaaaaatcttccatatatattactttattgtttatttcaagaatcctctgaggtatttattattattctaaccttgtgttggaggacaggcctatgctccctcaataattgcagctatcagaattgttttccttgaggctaaaaggtagctgtgtgtgtagtgagagagaggggagcggaaagagaatatgttgactcacatccttcagtaaatctgtttattccaactctggcattgctgccaaatgtgttgcaaagccagcaagacttggctctggaaaactcacctgaaagtcacaggcctcatttcctactgccagccccttcagccaccaggcatgaagtattggacaaagttaaagattaattcttcatttactgtgacaaaattaccacttctcccagatcagtaggcaaaggcatttgtatgctgtgtccttcataacctttgataatctctccactgccatcctgatggcccagtaatgcaaatgtaatcaaaccccacactggctatcccgttaccagcccaatcttgctaataaacagcaattgtggctttgttataaaagtgatcctagatcatttgtcaccacccaaaccttcccaccccaacccctgactgctggaaatcctttaaaggtctgtttaaggttacatgaaataaaaactgcaaaaaagttacagaaaaccttcactaatcaatgagtaagatgataatagatataccgtaaaatccatggtcaacagggtcctggcttttttttcctagggtgtaaatatgtgacaataaactaagtaacaagatgatataaactctgtaatctatatctgggttattccaaagcttctgggaagccatctggaaccagggacaacagtggaaaatgatcagtggtctgggccaagtagagcatagctgaacaagagccaaagctttaatactgactggtctcttcctaatgaaggatgcaaactgcatacttccttgggcctttaaaagatgcctttcatgcacagagggaaaatgggtgatttttactgacattattatatgcaagggattactgttattgaaattatataccttaaatactcttccatctcaacctcatccatcacactacactctttagttgtgactatgttcactttttgaccgtctcctgaattaatcatgtcctatgtctcatctaatctcccttcctttgcaaatgctgtttcatatgatcatccatctctcatcacaaccctcttggttaagtagccaaaatcttccacgacaactctttaacatccttggagactcaccctaagcatcctctattaacgctacttactctccttctctacccctcctactttcaggatgagtcagatgtcccttctctcttctcctcaaacactttctatacctttttattacaatgcctatcacattctgctgtgactaccaatattttaaaaatcagtcttttactagatgaagaatttttggaggaaaaggtcactgtcttacttattctggttggattctgagtacctgatgtataatgtatcctcaataaatgttgaatgattaagtggacaatgaaaaccatttcatttaggtctctacactcattttatagtaactgaaccatagagtgggtaaaatggatatatcatttagttaaccatgggtatattctgttaagtgaatgtgtactctattggaaataagagttgaacagaatgtagtaagataaaactgctacacaatgctttgtagtactttgagcatctgttttatgtcaaatagtgtatctattgcttaacccataattaatcttcatgacaccaatgcatgtacagatgattcatttctcttagccttcatctaatgctaaagacattgttattattattcaagtacaaaattgaagatatttgtatttgcttaacctgaaaataccaaatctcaaagatcaggataaatgagggtcacgagagatttataaaaaatgaatttttaaaaaagtgtatcacttagaatgtcccataatgggcaaattgatctattaggtcaggattttttttaatgtgttttgtgatcaagaataaatgttgacagaaaaagaagacaaggagttgggtttctaagtaatttcttattacaatcaaagtaaaaatattaagttgcacacaaacctgattacgtcattttccttagctccccattagctagctcctcataaataaaaggtaaggtctaatcttattgtggtttacaatccccttcacactggcctaaggttatttttgtaacccctatatccagtcgtttagtctaacctatccactccatatgcccaatccaccatactttgatattttgttttttaaatatcttcttgtctatgaacatactattcttgccacatgatatgtcttctttctccctgttcttttgaaatctcatgtgttcttctaggtctaggtcaaatgttttctataaacattttcccttctccacttgtatctacaaacgacagagttaattgctcttcctttatacttccagtatactttatacacatttctattttacaacatgtactctcttgttaaatactaaggaccaaatattgttcatttctgtgattccagtgcctggcatagagtttgctgtcgatacgtctttgttgaacatagaataaatgattaaataattaattggcatttacaaaaactgatccaaagtgtcaacaagtattgttattgatgtcagtgatgatgatgatgataattttatgggagcaacttcaatttactgaatgattaatacatgtcaggcagtatggcagattcttatgtacattttctatacctcacattttacagatgaggagttaaggcacacagaacttaaattacttatccaagaccaaacagagagtgaatcccaaagttagaattcacacgtctgcctatctgggctccaaaacccaggcttactctcatatgatgtgtatgcattggccaatggctactgtattccagataccacattagccattttacaaatggtgtttttttatccttataattaccttgtagaaacaacaaccttgagaggtaattatcatctctgttttacagatgagcaagctgagaccctacctccagccccctccagttcaccccctacgaaaaaattccaactcaactgtctacaatctcaaacaggctacaaactatataaagtacagtgctagttgtagacatgcaacagaaatttaaaatccaaagaaatgttagaatttcaaacaaattttaacaaagaatccattgaaccgttgcaaagatccttaatacaaaaacgaaagtcacaaagtgaataaccatattaggacacttcatattctctcaattcaatagctccctaagtgggctcatcccaactttccagtatctcccaaagtgaattttttgtttcagttgggacattctttagcgtacatcctcttgtttctattcctcctttttgatgatgaggtcccctctgtctctttcatccaaacctccaaaatcaatctaatatactccttttctttcatgtctaaacttctcccttctatacaatttatgccaattattaaacaattagacattattcctattcctttatatcacaatgcattttagcattacaactttgcatttataataatatcttaacaaataaacattactcatattactttatatcattctaaactatgtgtatgtatctcaactttgcttctataactatatcttaagtatggatcatatatagtaatgacacagatgctttacacttgcataatgcaaaaaatatttattcaagaatcactctctgaagtttccctcagcaatgctttgaaataggcaaagcaaatataatttttattttacagatgaggattgagattctgagaggtaaagaaaactgcccaaatttataaaggtaatgaaggtagagtcacgttgaaggataggtcttctgatttccatactctttctataatggcttgctatcatacacatttatgatacctagatctctttttgaccttagtcccaagtatgtaatgcttaattaaggtgataaactgagacattagttactgacttaggctagtaatcaaacccctctccccagccaagggactgggtattcacatcaacatttattttttcccttgggatttcatacaactccaaaagactttcttgactcactatctggagagttttatctatgatgatggttatctgtcagtaactgggctatatgacatcacatgggaaactggatttaaagaaaccacattgctaatgagatcatcagataaatagtcattgtaagggtggggctttttatttgatgggacattctatttcaagccatattgaaagcatatgtcgtttgccagtgttgaggcactttaaagttgggtctatactgcattgtaatatacaactgaaagaaaaattcgctgatcccctgggtaataagtactacatggtttccaggtagtttagtaaactttccaagcctcaactccatattggactcatagggataaagtgggttacagttatgactatgcaccaaagcttaatgctaccagtctcatttgtatgagaaggaaaattaagagacttttcaaaattatttagccaaggcttcctggaaaatagggtttgtgctcaatgttatagatgtgcttgctgatgatggttttctttttgcttttaaacaagttgatatggaaaaaggtaaaagctctactccaccatgaaccaagcctatacaatgtcagatttgtaggaaataatgacattattgcatgcttactatgtggtagaaactgtgctgtgtgaaaatcattggacataatatctcatttagttgatagaacaaacatgtgacacgtgtactgttatctcttttctacacataaggaaactgaagttatgccattttaatgttaagattaggaaaacagtgtaggaaatattccttgcttgtagagattgctgatcctaagatgctagaggcatttgggtaatagcctcatctgtttgattgacagggtaatgtacaactcaaatgctaccttaattctagctctaaattgtaatcatctaaaacttttacttccaaattctctaagacttcaattcatttaacctaatttattctttcagagacatcaaaataaaaaatattaaataaaaatatttgaaaggaatcttgaaccaaaacataaatgatatactgaattttgactcaggtagacctggatgtgaaacctctagtctgaagctctgtgggctttggttgctatatctataagattatcccacaaattctaagaatagatgaattaaatatgtgcaatatatgtacaatgtgtgaaaataccacataattcaaatggttattgatgttattattatgaataaactgacaaagaagtaaagttacataaggaggaagtaggatgcattgtaaaaattaaatcaggcagctctcgtttgaccaagaaatttctctcctcgtgctgctaagcatacattcttgctgatctgagctgctttggtaggaagggaatggtgctcttgcagtacacggaaaaatcattctggttctctctctctccctctctctttctgtctctgatctcttcacagaccctggatgccttacattttcagaaaagtgagatctgagtttaacggaaagccagaggaactcccaaatcatgccctttagcctagctatgttgcattaagtagccaaagctgatgtgatctcacaaataaaagacatacatgctactgacccagcatctagctaagcctggccaaacagtctcattttccaacagtttcatcaaaaccaaattattagtgcagaaccaccaaatatgccaagcccaggtgtctgtactttaagcaatatatccaaataggcccaaggagaaatttgggggtgggttagaggaagtgttggaacctttggttaacaaaacactaagctacaaagcgccaatgttttcctgaaagcaaatgccaccaaatgaaattcagtcaatatatcttccacatgacaaagctactaccaacattttccttctgtaaagtgtttagactacagacttttactagccttttccagcctggtgtttctcaataatgaagccaactctatcaatgcttcaagtatcaatgtctggtaactctgtaaggattagcacccacttagtggtcaggaaaattcattccaagatgctaaagaggtgctttgtttttaatatttttaatttaagatttagtagattctatgatcacagggttatgttcctttcaatagagctcagtcatgagtaaattaaaactgcaaatcatggagacagaaatgaaagatccactaaactctctcaaagccacaaatattcaaccttagtgcattgcatttcctatacatcctaaggctgccagatggaaaaagaatggagtctgagtctcccaaactgtagcaattgtgagtcataatcatattactaataataattctcacatacatgggcattactgaatgagtggctctgcttacaggaggatgaggccaccctgaccatggagaagaaatggccttttaaagtttatggatgtgtaaaataaagagtatatgatgttgcatccctgcctaaatgtcttcataaagtgcaaattaatgcagatcctaactaggcatttggaacgctaacctagttttctgtgtttagctaatagctagcaattttgcttacacttttatcctctcattacatagcaataatgattatttagtaaatacatatgaaaggccatgtactccatagcactcctcctgagttggaaatccccctcctaatgcttccatttgaataatttagttgctgatacaccaaatcaaatatagctgtgacaggtatcccactaatgctttttttggaggctaagatcagaccctttctcagcctgttcccctcggtgattgcctggcgaaattcagggtaagggctggggacagagaggatgctggaggaaatccagagccttaatcaatgttaaccctttataaatcttaaaggtactcagatggcttgtctgatttgaaaattattaatgacactggggagaagtaaggaaaggctattttataactagtcaaatattctggaacaagagagagagtttgaaatagacatgtagaagagaaagatgtaaaatatggccttgtgagatgccacccacttcatatctggacatatgactgatataaacctttacaagtcacttgagaattttcactcctagatgcagaatggaataatagaagtcccactagaggagttggggtgaccccagggcacattttcttgtctgccaggtacacaacacatctcactgatgtatcacagagacaaatttcttaatagggtagccaagccccacacagaatgatttcggataagagtcccattccttccctatgaggagaaaattggaagccagactgggatttggaacagagtccagggtgagggcagaactagggttgttttctcctatccagaatcaggtctggcttaaagggaggggattgacagggctgaaggaagaggcaggaaacatgtctctccaccccagtgctgcttaaatgtggctgctcaaaggggcaatatcctgctctcctcttctgatgacttcatgggaagttggccgagtccccacttctgcagaagaatgcaggcagaagggagcactacaaatgggcttttccttgggtgcttaagtggcaggtgtgaagggaaatggggtgggtgccttcaatgggaggagccactgaactggggaatactgctggtccaggggctttcccctttccctcccagcttcctcccaaccccaattccctgcatcaacaaagacagtgctcaaaaaccagaactcgtcctaacacactcaggcacaggtgtccacaagcccaacctctttcacctcaacaccctgaaatcccgtttgctcttaaaagcacagacaggcccaagtagactgagaggtctgagccagcacatccttgctactgggaattaaaaaacaccgtgatgtaaagaaagtggtatttgtgacactgtagtgctttaacaagaaaattgggggggtagaggagggtgtgtcagcaggtttcaaagcatcacaatcagtcctgatgtgtttgggtaaggcatggaggacatatctctgatccctgctggtactctccagtcccgcatcctcccgcagtctcttgaaagtggttagatacccgggcagggccccgcgtccattttgccagccaggaaccaccgagtctgggaactttgaaagccaggggatgggggtggttgttgccaaggctcggatttcggcgccagagttctcagccaggaaagcagttgaaaatcaacacccatctgcctcttctttctcatcccccaccactttttccttcacccttctaggactgcacacagatcctaaccacccccccccgcaaaacacacacattcacacacccttgggctgagaagatttttgattctgaaggcggcaaacccgcagaactcaaagggtctcgccacccctctctctgccccgcggctatatacaataaaaccccatacaccccagacatcacaacataatccaaatcagccagtgacttcggcgcgtcccgtacctgatatgcagacgatgaaattggcttgaagaagaaaaagcacctcccagactatttccatcctctgattctcattccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatgtgcgccccagatgtgctgacacatgtccgatgcctcgctgccttggaggtctccccgctcgcgtgtctcttctcttcgcaccagcggcggaaaccgcactagcagcggcggcggcggcggcggcggcagcagccacctgaagccaccaacactgggctcttccagcaaaaacgagaccccgattcgtctggcgccccaagaagacatagacgatagccccccgccgggctgcgccgtgcaattccgggctcccgggagcgcgtagctcgctggctaagcccaggcagtccgcggcaagttgccctcgaagtccgcccccctcaccggggcatggtcggagggtggctgctgcgctccggggcagttcttctcctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagag

SEQ ID NO: 1501 - DNA, 6834 bp, Homo sapiens
ttctacagcatctttttattgtctttaccattactttaatgcattttaaaatttatctacattaattgggaacaaagaaaaatagacatttctttgtttttcataaataactaatcttcatatttgataaaaatctcaaatgattattttaccttcccacaaatataatacatacaaaatttttctgaagtaaggtcaacaaattaagtatcttgagactaacataaccacatacaactgctgtttctactgactcccaggaacgaagcagaaacaaaaactcatcaagctgctctgggtttccttttgtaagtgttacagattcagaactgtaatcatgtatcatctgccagtaataacatatggattcaaattgattgtctacaaataaagtatcgctggctctagtgtaacttctggatttaacataacagtgactacagcatgggataggcactatacatatatggaaatcataaacagtatcgaatgccctggacttcaactactgactcggtatgtgcctcatttggctcagtaataaattcacctgcaccaaacccgtatcaaaagtcaccaaatctctcatatatatatataatatatattatgtatatatacaacccacaaaacatacatactatacatagtttgtaacaacatgaagtcatactgtcttaaaatgatgcactcacagacagacactatcctggctgaaataaatcctattgtcatcaggctgctagcttttgagagtcttgactcaggttagctacttatattctgcctactcttcacccttctttaacgtcttggcagttctttcagaaccaccctccgcaatccagacagatttgtttcccaggatcacttgattggactttggaaacaagaaagagcatgcagagggagcaggcaattcttagccactgtccctcacacctgcctatacgtgtgatgtgctctgtcctgttggccacatttagtgttagaaagcagttattcaaagctctgtccctcctaccccccttgggctttctgtagagcacaaaagtgaaagaagcttctttggctggggtagcagttcattaaaatatacaactacatttcctagctctggggttcccattctgtactggagagtgcaggtcacggatgctgttattaaggtttggtgtgtgatccatgaggttttctcctggcagccggtgtcaggattagcgcagctccagcccaggaggcaacagcctaatgaataccaactttgaaacagtgctgtcggcacgttatttaagcttgtacatgcccacaattacacacaacacacacatgggccttggtcactggcaatggtcatgagaaaatatgagaaaggtttgcaaggaaaaccaataaggcaccaagaaaaattatttccagtcaattttaccatttcaaaatgtgagaaggaaaatcatagaaattaaaaagatttcctaaaatctggtcagctaattcactgagaggtcccattagttcctttagacaacctacctgaatggaatccttaccccctaagctatgaagtgaggcattgcttaaaatcaaactgaaagggacagccctgaagctgtacacataagagactccaatgggccctaagtcctccccagctccacaaagctggctgtgaagaagttgctgaactactccataaccttttattttacagttgctttcatgagcatgacttgtttccataatcacatgcaaattgggggaagtaactatatggatggaaacagggggtggctgtaagtagatccagtttctctcccctggggtggctgatctcagtaagacttagggatgcaggtgggcttttatctttgtctctcttaggggatgagggaagagagggacagcagaggtgagaacagagacaaagaagtgcttctgaaagttggtctggaattagaccccaaagatcctgactaatattgccccccacttgggcttagcgtcctttgttttaactggcttatttttaaagtaaattagttgttcagcatgttgctaaaacaaaacaaaaaaaaattctaaaaatgaattaaatcactttcatccacttcatcccacaacttttggatacactgtgcatcatttccagatttctccacaaagaaggagggacaacccaaatgaggcacaatgactgaaggcagcagagcagtctgtctactttctgggaagacatatgaaatgagggaaaaggtcaaggtgatcagaaaaggttctctcatttgaaaaacaggagaggaattggcattcagtcaagggatctatttcaagattctaggaagaggcttcttcctagaagaataaatagaggaataaaataggcacaaagttctgtagctatttgtacgaggttttgtagaatccactgaaattttaattcagaggataaattgggtaagagcagtgcattttaataaatgtgaagtttttgagagtccttacaactttaatactaggtttcttcccaccagtaaagtgtttaaattccccctgggaactatgcatttgtctatttaacatccatgaagtaaaaattgtcctaggcttaaattttacttttccaactttggtataagtgaattacaaatgcctacactcaagttgttttcctagacaggattttctcaaatgttaattgctctggccattttagcttcctaaatttagtccccaatcctggtcattggtattttgctggctgaggcactgtcaccccccttccccagtaatggccccacactcttcatgaatgaatgcttaaacagattaggaaagcaaacagaattttctaatagcaaagaaacctctgtgtgtatgttcatcaatataagcgttcataatgaatgaaggaatagttaaacagattagtaaagcaaaccaaattctctaattgcaaagtgtgtgtgtgtgtgatcatcaatatacaggctttctcagaagaggaagaaaactatagaggtagcactatactgatctatattttaaaaggttgtgcaagcatgttatgcatctcttttgttttcagagacggcagagagcaacgtcttgctgctcttggaatatctggctataaactagtccaaagtccaggaacacttattttcccttatttgggccaatgtttgttcacaggtagccagcctccctcccccagttcaagcacttcattcaagggtgggtgtggtttctaatcacagctctccaggagaggaggaataagaaaagcaaaaaggctgtttaacatgataaagggggaggggggaggggggagggggtggagcaaataagtgttggaaatttacttattagaagtatatccatttcagtccttacatttaaaaaggagccccctttagcaactgtcgctaagtattgtccagagggagtgggtttatacttttaccaaaattataacacaagttccttaaaaaaaaaaaaaaaaaaaaaaaaaggggatcactgaagcttaagaaccacccactacctctcaggcacaaagctgccatctcaccagcctaaaattcaagctccaccaatcaccatcgcttaggctctcactactgcaaatatttatgccagatcctctataatgctacctctaacttattcaagacacaacgatggtgctgttaggagtgagaattattacaagcactacagaaaagaaactgaacctccctctataaacaaagctaaggctgaacacaaaaccgctaagcactccctaaccttgtcactttggggaggccctgagctcattatgctcccctcctaggtatgacctggggctataaactgcagctcaccttaaagaatcatggacactttaagcagtggaaggagaagctggctgaaaaagcacacccaacaacttcccagtcacagcaaccgaaacgttcactgttcacatttttttttaaagacacacgtataggaaatatattttcccaattgagaccacacagttcaaagaaacctgaaccaagtggaacttcattacaacgccaaccttaggattgtaaagcccccaaagcaaaggtaaattgttgccaaaatgcaacaaagttacaaattaagaaaaatacatataaattaaaaagagggttcccataaagaaggcagtaagaaacgcaaaatagaatacacgtgagctgggccccttggagaagacctgggacaggttcttcctcgaaaacgcccctcttccctctctccaagtcgccgcgggagggggcaacagcaccatgaaggtaaacggaagtgaccttggcaaaactaccaaacaaaacgcccccctcccctcagctctccggccgagtccctcggcggcagcctcctacacgtgcgacagggacacctgcttgtggtaggtggcggcggggcccggcggcccggtcctgcctgtgagcgcggcgctcgcctcggggtagtcccctgcggccatggcgcccccgctcttgtggccgcgccgcgggcggcagcagcagcggctggtgaaacgccgccacgactccaccgtcttgcccgaccagatccagacgcccgacgtgatgcccaccaccaggcacatgaagtacttgagcatgagcacccagtactcgggcttggcgcgcggctggccggtgtcgtggcccgggcaggcgcaggtgagcgccgcctcccagctctcgcggtagtgctgctcgtacaggtagcaggccaccacaatgctggcggggaccgtgtagagcagcgtgaagatgccgatgcggatcatgagcttctccagcttgtccgtcttggtgccgccctgcttgatgacgctgcggatgcggaagagcgacacgaagcccgccagcaggaagagcgtgcccaccagcaggtagagcaccagcgggcccagcacgaagccgcgcagcgagttcaggttctggttgcccacgtagcagatgccggccactgggtccccgtccacggagctcagcgccagtgccgtgatggacttgacgctggggatgagccacgcagccaggtggaagtactgcgcgtagcccgcgatggcctcgttgccccacttcatgccggcggccaggaaccaggtgagcgacaggatgacccaccagatggagctggccatgccgaagaagtagaccaggaggaagacgatggtgcacagtgcagggcccgtggtctcgtagtggatgtggttgtgctcgcggctgcaggccacgctggcatggcccacgaccagacgcaccaggaagcccagcgacacgcacaggtagcaggctgacaggaagatgatggggcgctcaggatagcggaagcgttccatgtcgatgaggaaggtggccactgtggtggacgtggagatgaagcacagcaccgaccacaggcctatccagaaggtggcgaacgtgcgctcgtcggcactgaaggacggctggtagcagggtaccgcgcagttgggcacctggcccgtccgcaccttgttgtagagcgggtgtgactccttcagaatgggcacgaagggctcgcgacacttgcacacgaacgggcccccagcggggcattcgccccccgaggccggcgcccctggcgggcctggaagggtgggcttggctgggaaaggcctggggggcgccgtggtggcctcgctgcggttgtaatccatgcagaggacctcggcgtcgcggcccagcaccgggaggcggtcgcagctcatgcgctcgggccaggcgaagccgtactggcgcatcagcggcgagcagccggccttggcgcgctcgcacaccgagcggcagggcggcagcggcttgtggtagtcgggcagacagatgggcgtgtacatagagcataggaagaagcgcaggtccggcgagcattggatctccaccagcggccagaactggtgcacctccaggcccgcctcgtcctgcgtgtcgtggttgaactggttgggcatgtgcgtcaggttgtagccgatgccgcggcacatgggcaccgtgatttcctggcacaccggggccttggacgcggcggccgcccggcccaccagctgcgctaggagcagcagcaacagcgagggcggcgcggatgggtcaggccgagccatcgccccctccctcccctcgcctccagcagcccgcgagggacgcacacaggcagaggaatccgggccggggcttctccctccggcgtctcgtgtgtggcgccggggctggcaacctgttggttgctttttcctttaaagaaaaccgtccaaagataaactgcttcgggaaggcgctgcctccgctggcagcgctccgctcctcgccggatagggctggggagagacggttagggctcggattccagggaaaggactctttaaaaaagaagggggagaagaaagattgcaaccactccctgttggagaggcgtcaacagttcggtccccgcgagctgtctccaaatctcttaagttaacccctttcctttcctccccgctccgcctcctgtaaccaaactaccgactcccccaccctctctttccaagctgggcccttcaggcagtgcccggagaccagaaccctcagcttcccggaaaagggcacaggaaacgggagaagaacagggagaaagggaaggttctcacctccacggatcccgccgagaagagcagacagtccccagccagcctgggtcctccgtccctgggtcactccgctgagaagcgcgactcagagccgggctggcgcccggaaagtttagcgacaggctgggtacccgtggcagcggcacatggcagca

SEQ ID NO: 1502 - DNA, 17217 bp, Homo sapiens
ttgggtaagaaaattttatttcacaatgtaaagggttatgtgagacccaactgtattctatctgaagcattagaagccaactgtagtaaatgcatcttacttatattcgatgctggccagaggagctattctgcttcctttagaagttatgctttttattgtggcttgtggtaaccatgtaacatgcaagagcaatggttttcaggaagaaactattatgccttacagcttttgccccaaatcacaagaaaacttgaactatgtcattaaacatcccataaatgctgacagaagataaaggatatttattatatgaaattgtctacgccctcagactacaattcctgaatagttagatggtgaccatgttcatccttctggattaatgaaaacttggaaagcagtcaaagctgcctgggccctggctggctggctctcccttcagcctgctccccccaggagccctgagcatctccttctgccattgcctgtacagcttggaggcttttcacatcttggagagcttgatgtcataagtgaccatgttcaagttgtcccaggcaaagagcttcttctccagggggttgtagtcaatcatgctgctgtacttatagcggttcttgaatgggatggtcagggtcttgctgatacctgtgcctgtgtcataagcaaagttgacggtagcatctgctgaggtgtagctgctgacggtgtacaaggtgccacagatgatgaaggcattggcgactgactgcttacggatgtttgtctcccaggtttgttcgagttccagattctctgggttcagtttggagaggacaatggcacctttggcctcatcggtgctgtaaatgacccagaggcctgcttcatccacagccaagtcaatgtccgtgtagccaccccaagaatacgggaactgtccgtggtagccagctccagggatttccttctcagccttcactgtctcggtattcagctcatatcttatgacagttctggactcagcgccctggaaatagaggctccccgagtacaccacagcacccgtgctttccagtggcctaggcagtatgtgaaccttagaagggtagccctgcataaactggctgatgaggtcatactcaaaaacctggcggacatccgtgccaactgtgtcgattctccacgtggtctcctgggtgtaggggtaggtgggcttggggtctcgcatccacacaccatacttgccagtaattgtttctgctgttctcagcgtgagaggctctcctacccaaactagttctccacatcctggtaaattcagaaaagaaaacgaagcaccacttaatccataatctttccaaacacagacaatgatcatgcggaagcttggcagagccagtagatgtgacagccctggagacaaatcgtctgggtttaaagctaggctctaccacccgctggctgtgtgactttcagtaagttacttagctctctacgcctcagttatcgcatttgtaaaaggggatactaatagtgttttgggtagtagggctgttgtaaattttaaatgtaattatatatgttaagtgcttggtatagagtaaatatatggtaaatgctatatgatcaatctgtgtttcatgttattgacaattattgctatcactgaggggcatgcatgggagtgggagctataaaatatttaaagtacaattcactcagtatcagttgtaaggatgaaagttgcacagagggcttcaactgcatttgtaatattctacttaagctgggcagggacccatgggtgttcattgtattacttattgtgactttcatgcctggtttatttcattactataaggtaggagagagaaaaatcaactcataagaataatctccatacaacaaagtttttcaagccctgatgagtcacatatttcatacatcattttaatataataaacatgaaaataattattttttgagacagggtcttgcactgttacctaggctggagtgcagtggtgcaatcacagtgcactgcagcctcgaccttccaggctcaagcacccctcccatctcagcctcctgagttgctgggactacaggtgcctgctaccacacctggctaatttggtttagaaaataattttttaaatgtagtgaagagacggttgaaaatttagagttaccagaatcacaacagatgtctgtattttttttttttttgagacagagtctcactctgtcgcccaggctggagggcagtggtgtgatctcggctcactgcaacctctgcctcctgggttcaagcaattttcctgcctcagcctcccaagtagctgggattacagatgactgccaccatgcctggctaatttttgtatttttagtagagacagtgtttcaccatgttggccaggctggtcttgaactcctgacctcaagtgatccgcccgcctcagcctcccaaagtgctgggattacaggcatgagccaccatgcctggtccagatttctctacttttaatggcaccttcggttccctcatagaaggtagaaacactttgctgctcatatcttagagaaccgtgttttaaatatttcataacccctacttgcatgcatgcccttcagtgctagtaatcattgtcaataacatggatagtcaaagtttctggaaatcacagtattagtcataaagttggactttcagggaacactttggagagagccaaactgtacttttcctaagtggccaaagttcagaaaacatactgttagtaacagattgtggctgagatggtgcttggtgtatacctgtccctaaaataaagatatgaaggcgctactgaaaaatgtaacttctcaagtatatctaattctacatgacaatcaagtggatgaaatcaacacatctctcatcttgccctgtgcagcccagcccagcctcccaagtgtgggtgataggatagagggctttgttagggaaaggctgactcctgcagacctgctctgacaagggaacagagagagagagagagttctgttcctcttctcctcccctccctctgctcccagggaagttaatttcccccttgggtgggcatttaccctatactgattctctgaacacagcactagacatgaataaagaccacgtgggcacaaaagggaagaaacttaacttcataccggtgtctccctctccactcctgagatagccagatgggctctccttcaaaattcgggaagcaggaacttcagttagctcggacttcagttcctggaaggccaaagtgtccaaattccacgtagaaactgcattaaaagaaagagacaaaattttactgtaagaaaaaatggcccaaggattgactatgttgaggatgacatttaaataggctgccggccaggcgtggtggctcatgcctgtaatcccagcactttgggaggccgaggcaggcggatcacctgaggtcaggagttcgagaccagcctggccaacatggtgaaaccctgtctttgctaaaaacacaaaagaattagctggatgtggtggcaggtgcctataatcccagcttcttgggagactgaggcaggagaattgcttgaaccaaggagggggagattgctgtgagccgagactacactattgtactccagcttgggcaacaagaaagaaactctgtctgaaaactaactaactaaataaataggctcccaaagatatggtgtttgagatttgattttagataaggactggggatgggttgggggtcagagaagggaagataaaacatgattggactgtgctgataacagttgggcctgagtgatggctacattggagttcattgtagtctctctacttttgtgaatatttgaacaattccataattaaaaacctcataaataataaattgcagggcaatgtgcctaccttagagtagggtattcaaaatcaaataatattttaattccactagaagggctggtttgtgaataggtgagtcgtaatttcaggaatatggagacagtcctcagcatcttcttagatgtctgaatttcaataattaaaaattcatgaaaaattagctgggcatggtggtaagcatctgcagtcctaggtacttgggaggctgatgtgggaggattgcttgagcccagaagttcaaggctgcagtgagctatgatcctgccactgcactccagcttgggtaacagagcaaggcccggtctcaaggtctcaaaaaaaaaaaaaaagagaccgggcacagtggctcacactgaaatcccagcactttgggaggccgaggcaggcggatcacttaaggccaggagttcaagactagcctggccagcgtggtgaaattccatctttactagaaatacaagaattagcagggtgtggtggcacatgcctgtagttccagatactcaggaggttgaggatcacttgaacccaggaggcaaaggttgcagggagccgggattgtgcaactgtactccagtctgggcaacagagcaagactctgtctcaagaaaaaaaaaaaaaaaaaaaaaaaaaaagaagtgtggctcatgtctgtaatcccagcactttgggaggccaagacaggaggagtacttgagcccaggtgttcaagaccagcttgggcaacatagggagactcctgttaaaaaaaaaaaaaagataaaagtttactgcatgacttaaggttttttcccttgttatatgcaaatattcttgtaagaagtaacatattaagctttatactttcagtagaaatattctgtctgattcctttctgagaccagttttgcataatggagagggagtgtgtgcagagttcctataggagtttggggtgggggtggtgagccatacagaagggaagcgggtgggcagcattggttagacagtaagtgatcatggtgtgctacatgtctctactcttgcttaggattatgatcttacagcagtcttgaatacaaggatgaggcaatagtcacaaggaacaggcttggctattttaaaatgcagtttggccaggcccagtggctcatacctgtaatcccagcactttgggaagccaaggtagacagatcactggagcccaggagttcaagacaaacctgggcaacatggtgaaatcccatctctacaaaaactacaaaaagttagcctgggtggtgatgtgtacctgcagtcccagctacttgggaggctgaggtgggaggatcacttgagaccgggaggtcaaggctgtggtgagcagtgatcgtacctctgcactccagccctggcgtagagtgagaccctgtcctcccctccaacctcccaaaaaacccatcacatacacataaaaacaaataaaatgcaggtttgatgattattcaggtgtggcaaggccaacatcccaggaggcaattgtcactgaaaagcaagttaaagcaaaattatggagacagtaaaaagatcagcagttgttgggtgaggaagggatgactaggtgaggcacagacgatttttagggcaatgaatactgtgtatgatactataatggtggacacatgtcactatgcatttgtctaaacccatagaaggcgcaacaccaaaaatgaaccctaatttaaaccgtggaccttgggtgttgtgcgtgctgatgcaggttcatcagttgtaacaactgctgtggcgggagatgatgataatcggggaggctgtgcatgtgtgggggccagtagtatctgggaactgtttgtacttttctctcaatttggctgtgaacataaaactgctctaaaaaaaaattatctttacaagttgttgtactcacagagcccaagaggaagggggcacactaagcccaggaggccacctggggaagcaccagggttgctccagaagagggcaccaggggaaaatgtgggaaagcgcctttattctttccatgggaaggaaagaaaggggaggcagggtaagcaggtttaggattggggagtttgaataatttcagcaggatctggggtcacaggagttatctctaattgtctggtaccaggccctgggtgattaggtcagggggacagtggccttgagtttgagccagatggaggtggtcacagggtgtgggctctggattggttggtttgcatatgaaagctgtcctcccaggtgagtcctttgctaaccgtaggaactggctacccctgggaggggcagtccctctcacgtttgcaaggcccagacagcaaagcatcagaataaaaagacatgcttaatacactgggcttttctcttgctgaacctctgagtcacttctctgccctttgagcaacttgttccccgctcaggattctcaggtgttcaggacagtgggaggaaagtcagtgcatcccctgaggccggagcgcctacacagccgagagggtcgggaagacatgttctgcctttgatcatttgtttgctcagctctcctaaatttagatttcaggcagagaggatcaccacagaagtcttaatcctctggttctaccacatttcatcaaagccacacattattttacattttcacatctccagagtcagggtaccttgtttgagttgctggggttcagcttcaacaaattatagtactggaaaaaatttctccctggaaggaggtgaagaaaacattcagctagctctcaggtgcaggctgggccagacagccatgctgcccacagtgagccagctcagtagctgctgcagctgcctgcccctgatcccagctacccttctctcctctccacccctgcctctgtgtggctgcagttgttagcctccctaaaagtgttaatgccctggaggtgggtgggtcctccatccctgggatatccctcagtctagagtgcaccatgtaagtagttaaaacccataagctggccaggcgcagtggctcatgcctgtaaacccagcactttgggaggccgaggtggcaggattgcatgaggccaagagtttgggaccaggctgggcaacatagcgagaccccatctttacaaaaaattaaagagttagctgggtgtggtggtgcagtctgtggtctcagctactcgggaggctgaggcaggaagatgactcttgagtccaagagggcaaggctgcagtgagccatgatcatgccactgcactccagtctgggtgacagagtgagaccctgtcttaaaaaaaaaaaaaattaaaaaaagaaagactcataagccaaaatgtatatgtaactgaggacatcctcaatgtgcattccaaactccaggggcaattgggagtaccccccgggacatggcaggccttcattattcctagcctcaaatccacagagctatttatccatccttttagtcacatcattggagcacctattgagtgcaaggctgtgctaggtgctcaagaaaaaaaggtgtctaagacacaagtttgtctaataggctagtctatgtttaaaaaaaaaaaaaaaaagacacaatcagtccatgcccttaaggaaatcataatctggcaaagtcctcatacccgagaaggaaaatgggtttattccaggctgctgcggaaaccagtttcttggacaatctgaatggctcctggagagtcctggaaacttttatttcattccctgcgtctccttctccctatctgaggttgtgcaggggtgaggaaacccctttgttcttcattctaaaggttgcattggcctaggagggtatccagggcagggactgattcactaggtcaaatggagtttccttagatcgacctgagaccagtaccagctgcttcccttctccccctgtgcaggcaacacacacctccggcagggacttggtgctgcctatgggggagagggacagggtgcccgaggttccctgttcttctgtgctgccagggagaggtaagagagagtgaccgccttcctgtacacaggtggcagaaccatctgtaaccttcctctctgatgctgcctcgccgattgccatgccttctctcttaggcccagaacacacacccaggctgttaggagcagcccaccgctccctggccctgccagcctcctgcaatgtgcagaggctcattcgatgtggcaaagtcttgccaggacaatttttcaaaatcagggcattaagcaagttccttgaattgagctggtttcctttcatctgtacctcttcttggatcactgcagactctgcctcaggacaactcaaatttcttttctttcattgtctcaactctcagaatataagagttgctgggcatggtggctcacgcctgtaattccagcactttgggaggctgaggtgggtggatcatgaggtcaggagttcgagaccagcctgaccaacatgctgaaaccctgtctctactaaaaatacaaaaattagccgggcatagtggcacatgcctgtaatctcagcaactagggaggctaagtcaggagaatcgtttgaacctgggaggcaaaggttgcagtgagctgagattgtgccattggactccagcctgggtgacagagagactctgtctcaaaaaaaaaaaaaaaaaaaaaaaaaggagttggtttcaggcaatgtgaggagagagaaatactgcatgccatctgtacacaaagtctggaggactgccccaaccttgtccctacacttcagctatgccatccacagttgccatgggagggtcccttaataaatgtgtcaatactaaaatttctctggaatgtttcaaaatcactaacatttcattctgaatgtggaagaaaaccaaaaagagattatgaaaatattaagggctatattgtgacagatcgttaacatttttagggcttttttttttaggtttttaaaaaaatattaaattcaggcgagccatccctcccctgcatctggcccctttacacatacaaaatgatgtattttatgctggttatttaatttaacaacttaccgagaaaagatgtatactaagaaaagtaggggtacctacctaccagtcagtggggagaaaattaagaaagaaatgccccttttgctatagagggaaggaagaaagtgaaacccaaaaaagtcaggcattttcacagatgacttccttgtggatagctaaagtatgtactggctttgcaactctaaaaaacagctttttttttttttttttttgtgaaacaagatggtttgtcggcatttatagctctttgcccatttcaagtaatttttatgtaatttttaaatgtgatctggtgccttcaaagtttcagagaaatagagaaaggctttaggactgcagatagcgcctgataaagttgaactatcgctactacttattaagtgtctcttatgagccagtactgtgctgggtgcttgctactcactactttcaaataatggtcctgaaagtgaacattaatatccccttttgcaaatgaggaaaccgaggttcagagaggttaagtaacatgcccaaggtcacacagctaagtggtatcgctgggacttgaacccatgtcttccgaggccatggcagctgcgaactcttccatcctgtgctgaggaggtgtgtcagttataaacgcattgcctctcagagctgaatgcaccctcccatgtatgctgtctgaagaacaagagctttgaagtgagcgcgatgttgaactatctcagtagagggcgctggagggacatcgtgggaggaaaaaggtctgcagttttcctgtcctgcgtccataggtggtatgactgtgaggacatttgttggagtcctaccccagccacggacccagagcgaagttcttctgtgacctcacagccacagcctggccataacctttccacagccctcccaacaaggaacccagagtccctgcacacggacctcagtgctctggaggcctcctgcctgtgcctgccctgactcccaccatgcccttgccacacgttgcaggttgccctcctcacctgcactgggaggcggcctattgcagctgcagaccagctgaggcctgcacaccttagccaccttctctgcaagctgatgtgctgaacctcaccttccccttccaagcttgtccggcaccctccctcagccctaggtgcctatggagttcacgtctatctatagttgctctttcatcacggttagtaattctttaaagtaaacttccccagcttaacccactgtgtgatttctatctcccgactggacccagatggctactggaggcttcagaagagtctcaaagatgctgctcagcactttgtggggtgacccactcctggggctgagctcaggtcccagtgggttgccttgtaaactctcagctcctgggctgtgcactcaatcctcttatcagttcttctaccctcactggcaaagaagaggcagcaaaagtgcctggctggtgccaagttccctgctgaatcccaccatggcccttacggctctgagcaaggagcccttcagattgtgccttgcaggaaccactccttatgtgcattagctggaataaacatgaactgcaataaaacaaaatgtcagggaatggcttccaggatgacggcaaggccagttcccatttggcaggggcgatggttaagttatgagcctgctggcttcttctaggtcatgtcagccaggagcatctggcaatggtcagactccaggaatagagccatctggcatgcgggtggaagcccagaatagaggatgcaaaacccaaaggcagggaaacaatctcgtaaaggggcctggacctaagccggaagtcatagctcctagttcagctctgccatgtcccagctgtgtgactttgggtaaatgactccacctctctgagccccagtatgctgagctgaattgtttggatgattacataagtaactataaatgaaatggccctcaataaagatgtgtcaacactaaaatttctctggaatgttttaaaatcactaacatttcattgtgaatgtggaggaaaaccaaaaagagactgtgaaaatattaagggctgtactgtgtcagatagttagcatttttggggcttttattttttaaggtttttttttttgtttttttttttttgagacagggtctcgctctgtcacccaggctggagtacagtggcatgatctcagctcattgcaacctctgcctcctgggttcaagtgattcttctgcctcagcctcctgagtagctgggactacaggtgcctgccaccacgcctggctaatttttgtatttttagtagagacagggttttaccatattggccaggctggtcacgaactcctgacctcgtgatccgcctgcctcagcctcccaaagtgctgggattacaggcgtgagccaccacgcccagctgttttttttctaggttttttaaaatgttaaattcagtccttctgtggtttaaaggttcatgtctattacaaaattctggaaatgttctgtgttctctgccgtcgcttctttatagacttggcattttagagacctcaacccggaaactgaatttattaactcgtttgcctgtagacataggcattgtaataattttcatagatattttctatcactggaaagttcagtccatattacataaatgaaaggaatgaagtaaaacaagctatgcctaattatctacaggttgtcagaaacatcttaggaaagtgaagactagctaatagactattgtcctgagtactgctctaacttgtactgtctctagaatcaacgcatgttattaaaatgttatgcacatgttgacatattgattattgaatgatgctttaaaacaatagtggaaccctggccaggtgcagtggctcatgcctgtaatcccagcactttgggaggctgaggcgggtggatcacgaggtcgggagttcaagaccagcctggccaacatggtgaaaccccatctccactaaaaatacaaaaattagccgggcatggtggcgtgtgcctgtaatcccagctacttgggaggctgaggcaggagaattgcttgaatccaggaggtggaggttgcagtgagccaagaccacgccactgcactccagcctggtgatagagcgagactccatcttcaaaaaacaaaacaaaacaaaaaacaaaaacaatagtggaactcaagtaaaataagcctttctagttatattttattcactgggtggccactgctcagcgctgcactgggtgcttccctgtgtgactgctaatttgcatgatgactcccatgagggattctcatccccatcctattctaggtgaggaaagggaatctgcagcacttgtgttgaacacctcaggtttctcccctcaccctcccctcacatcctgcccacttttttgcagtcattgctgaggcaacctgcctcttgcagttatcacctgcggggacctcgcctcagccaccgtggcccagcttctctgactttctgcatagaaagtctacaagaacaggccaggcgccgtggctcatgcctgtaatcccagcactttgggaggtcaagatgggtggatacttgaggtcaggagttcaagaccagcctggccaacatggtgaaaccctgtctgtactggaaaaaaaaaaaaatacaaaagttagctgggcgtggtagtgtgcacctgtaatcccagctactcgggaggctgaggcaggagaattgcttgaacccaggaggcggaggttgcagtgagccaagatcgtgccaccgcactccagcctgggggacagagaaagactccatcttaaaaaaaaaaaaaaaatcagtctgcaagaacaaacctcgtccccacatctgagtatcagggaagcgcaatatactccatgggatagcccttggccaagagggtatcagatccatgcgtaaacctcccctcttctgttgcagtctacacagcccctctgaagggcttgatgggattgagcctccattgcccactgtggtgactagctggagaaggcccccattttgtggctttcctgccttccctgtctcactttcccctgtctcaacttctcttctctaggatcatggtccatataaaccaactgcacacaagccctcttccaggctctgttcaacaggagaccagtccaaagcaggggctaaataacaaacaaagcagtccttctcttgtgacagtaataaccaactctaatttatcttctagtaaattatatatgtattttattatatatataataaatttatatatataattatatatatttatatgtattatatgtaatatatatatttttttgagatggagtctcgctctgtcacccaggctggagtgcagtagcgtgatcttggctcactgcaacgtctgcctcccaggttcaagcgattctcctgcctcagcctctggagtaactggattacaggtgcccgccaccacacccggctaatttttgtatttttagtagagacaagttttcaccacagtggccaggctggtcttaaactcctgacctcaagtgatctgtccacctcggcctcccaaagtgctaaggttacaggtgtgagccaccacacttggctaattgtattttttttctacttttcaaaaactattatatatacataaaatttatatatgtatatatatgaaaatttatataagcccagagaagaaaaagttatatataactttgtagtaatagttatgtagtaaaatatgtcatattatgtgtatgtataaacaagtgatttctatgattataaggaatttttttctacataacaactattaatacatgatcaagaaagtggtggtaacaatttgagttgcaggtggaatacagaaaggctgccttctcaggccttacctttgtccactcagcctcactaagcttctctacccaaaccttcacacctagttcttgccactcctgcaaaaaagcatacctagacttatattccagcctccagaatgcccccttttccctagatctggccttgaaacagatcttttgttccaagcattcctgtacctttctgtcttttacctttagggtctataaaccagaggtcagctgaaggtcttgaaagtcaatgaacctcatggccatgtacagggagggctcacacctgtaatcccagtgctttggaaggccgaggtcggcagatcacctgaggtcaggagttcgagactagcctgaccaacatggtgaaaccctgtctctactaaaaatacaaaattagccgggcatggtggcacatgcctataatcccagctactcaggaggctgaggtaggagaattgcttgaacccgggaggcagaggtttcagtgagccaagatcgtgccattacactctagcctgggcaacaagagtgaaactctgtctcaaaaaaaaagaaagaaagtcactgaacttcagaggaagaggccagaattcgagctttgccactaactggtagatggccatggacaagctgaataacctctctgggcctcagtttccatatctgcaaaaatcagccagcggtaccggatgctcattaggtccctttccagttccacattcttgtactaatgtaatttcctgctcatgaaaaacatctactactagaaaagaacttccatgtttggtgttcaatataatgggatgttgcccttatttcaaaagtggagtagctggaaagatcaagaaaaaatataaaattaggaaacacatctaataaatccccaaagacttgttaaatgaccacaaaagaaaaaaaaaggcaaaacattgccactatttttgtacacacacacacacaccacccacacccacatacacacatgcaggagtttttattgagaatgtaacttcattcaacagtctgaaataagtaatgcctcatcacacttctggtaatgatgattctttcaattgtctccacagattcaagtctcaagctctaccactgaccagctgggcaaccttggccccttagcatcttaggacttcactttccttggttgtaaaattcagaattggatctcttctaattctaacaatctaaacattttttaaaaatcctttacatcttataggtatttcatgtgaaccccacaaaaattattcacagcaggaattttctttgttatgttatggacaagaaatgaagatgcagagggttcaataacttgcccaaggtcatccccaggctctggctcttaggttttctaaccccatagctatgaagagcttgcctttcacgtagaaggctctttttaggaaatattttctcataattttaaagcttttcaagcctatagaaaaactgaaagaatagtacaataagctccccatatacttagattcaccagtttgtaattcaccagttattaatattttgccacagttgttttacctttctttctctcattatctatatatttgcagtctttcttcaaccatttgagagcaaattgcagacatcctgacgcctcaccctgggtacttaagcatgtatctccatagaacaaagattttatccttcgcaaccacagtatcattatctcaccaagaaactgaacattaatacagtaacataataatgagcagtcaaattgcctcagttatcccaaacctgttcctcatagcctttttcccccttggatgaagacaccaatcaagactcatgcactacatttggttaacacatttctttagtctctttaatatagaacaagcccttccccaccccttttttctttcttccttggcactgacatctttgaccagtccaaactaattgtccaacaactggatttgcttgcttatttcctcatgattagaacacttcctcaacagggaatatttgggagcccactttcacaaaaagtgacacaaataccatcttcccagctaataagaagacctcccccaacacctcacccccgcaccccccccacacacacacagactcacctttaggcaagaagggaccaggatgaacagaagagcctctcagaaaaagccatctcaagaatttgtctgatgacttaaaagcagaggttctcagattggactgagtaagaaaactttcagaacaacatattaagaaaactgacagagaggtgccatctctttattttgccagggaagaacatttaaaaataaacaaaaacttaccacttattatcatttcccaaatctattgtaatttcataaataaaggtcattttaacatcaaaaggtacaaataacaatctgagcaaaggttcaaaaaaggatagtttttcaaaagggacaattgacaactttctactgctcatatgcagacacatctcacccggtccttttatttctccttttgctatggactgtgaaaactgacatggaggggcacaagaactctgaaccactaatctaaatgaagctctcaggagctaaattactagtaatacttgaaggtgatcgctgtgctttccttaattcatctgtcttgtgctagctgtgcagtctctaggagaaagggcaggcagggaggcctggagcgcctgtagcaggtcactacgagccatatcacctgctgaactcagagtccccccactctgcattcttaccttctctggagcctggtggcacagcccgagcagtgtctcgggtctggggacactggccccttctcagccttgctacctcctggctgctgctttccaacctcctggccagattctcattttcttgccttagtcgcttcttctcttcctccagaactgacttgtctcggaggaggttgctgtaggcagtctccaactctctggtttgggtttccagctggtcccgctcccgcctcagggtgcccagctccctctgcagcccctcctgggtctcctggggcctggcagcctggtccaaggtcaattggtggaggaggctctccagggagctgagtcgagctttggtggcctccaggtctaagcgttgggtgctgctgtctctctgtaagttatggatgactgacatggcctggctctgctctgggcagctggattcattgggactggccacactgaaggtatactggcatcggccactctggtcattggccttcctgagctgagctgtcctggcccccacatcccacaccaggcaggccagaagcagcagctggacagctggcatctcaggcccaaagctgcagcaacgtgcacagaagaacctcattgcagaggcttggtgaggcttc

SEQ ID NO: 1503 - DNA, 16211 bp, Homo sapiens
attagggcattttaaaaattttatttcttggctcttagtttatcatgtagaaaaatcctccatgaaatattgctataattacaatacagccttgggaaggaagctcaggggctgtgaatggaatcctaatctgcctgaaatcttgatccagacagaccaaatctcttccctcagagacttcaaacactgcagtcttcaaactacatccaagaaaatcttcatccaagtaaaatttcccccaaatatcctttctctaccccaccctatcctgtagttagggaaaaacccaggactgaatcaatatcctcagacctttccgttcaagtgggatcagaacctttagtaaccacatcggcaacagaggttgaaaccacaccttcaagaaatagtattcacatgtgacctggtcctagacttccagtaagaatgactcagagtctccccgctctgaaatactgaagtatttattggtcttagggtattctcgggaaggtgacagtgaggggttcttcaaaggagaacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagc

SEQ ID NO: 1504 - DNA, 16211 bp, Homo sapiens; identical to SEQ ID NO: 1503

SEQ ID NO: 1505 - DNA, 8585 bp, Homo sapiens
gaaatactgaagtatttattggtcttagggtattctcgggaaggtgacagtgaggggttcttcaaaggagaacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagc

SEQ ID NO: 1506 - DNA, 73907 bp, Homo sapiens
tacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtct

SEQ ID NO: 1507 - DNA, 2285 bp, Homo sapiens
tcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtct

SEQ ID NO: 1508 - DNA, 36133 bp, Homo sapiens
ctctttctgacagtgcagggattctgaagctgtctgcttgagttactgtgctctcttccaaggctgtaggagttctggagctgctggctggagaggagggtggacgaagctctctctagaaagacatcctgagaggacttggcaggtgagcactgtttcaaggaatgggctgatggggtcataatccatgataacctcaccaatcttttagagtcacagctggtgagaagagcaaaaatcctcacagaaaagcagaaattcctagggaccatgaaagacagtacctgccaagtcttaggaggaaacactgggcagaggaaaaggcacctttatggcagcaacagggagagacgagggcagctggaaaaaggtggtaacagggggctggtagttgggtggtggtcagagaaggatgaatctcagaggaggtgagaccagaagaatgaagaagagcttattatggaaaaagagagggaccagcaggtacaaaggcaatgtgtagttctgctcaggagctggtacagtaatcttcaattcttattccatagaaaaaaaggagacagaaatgtcagacactgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgtgagttaatactgaataaactgtatatatatatacagttgtgtatatatatatacacacatacatatgttaatacttagtaaactcatatatatgcttatatatatgagtttataagtattacttatacatatgagtttataaaatatatatattccattagttctgtttctctagagaaccctgactaatacagattttggtaccagaagtggttctagaggaaaagaatattaaggatggagttcttttgttggttttggggtttctggagttggtgccttaatatgattagaccccaaaatactaaggactctacttctaatagtatggagaagactgatagcccttggtgtgaactgtttaaagagttatacaaaataaatgcatttgacactcctgattcattgctcatgagaggcaaggagtttagtgaccctatacatcatacctttgaccatatgtggagaaccaaggaacataatgaagctggttggttgctcctaagttcagtggataaagtgatgaaagaaaatgatgaactcggggattctatctcaccgcttcagaagcagatactgagcctcaaatctgccaagattgccctgagtgagagtctaatctcctgtagagaaagaactgaaattgtggaaaaatagacataagctcttatcatgttagtggctgacctgcaatgaaaggtgcatgcacagcctcaccatgcacagcctcaccaagtatctactgttaaagtgagggcattgattgttttgcaggaagtcagggaccctgaatggagggatcggccagagctgaggcagaagaacataaattgtgaagatttcatggatatttatcacttcccaaaattaatacttttataatttcttatgcctgtctttactgcaatctctgaacataaattgtgaagatttcatggacatttatcacgtccccaattaacactcttatagtttcttatgcctatctttactttaatctcttaatcctgttatcttcataagctcagaatgtaattcacctcaggactactattgcacaaatggattgtaaaacatgtgtgtttgaacaatatgaaatcagtatacctggaaaaagaacagaatatcagtgattttcagggaacaatggaagataactataaggtctgactgcctgcggggtcgggcagaatagagccatatttttcttcttgcagaaagcctatagaaggatgtgcaagtaggagaaatattgctgaattcttttcccagcatggaagaaccctggggaaggaatgcattcctgggggtaggtctatagatggcctctctgggagtgtttgtcttatgcggttgagataaggactgaaatacgccctggtgtcctgcagtaccctcaggcttactaggattgggaaattccagccgggtaaattctagtcagagtggttctctgttctcaaaccctgtttcctgtgaagatgtttatcaagacaatgtgtgcacagcaggacatagaccctcatcagtaattctaattttgcctttgccttgtgatctttactgccctttgaagcatgtgatccttgtgacctactccctgttcatacaccctctcctcttttaaaatccctaataaaaacttgctggttttgctgctcggggtcaccatcatagtcctaccactatgtgatgacagccccagaggcccagctgtaaaatttctgtctttgtactcgttctctttatttctcagaccggccgacacttaggaaaaatagaaagaacctatgttcaaatattgtgggctggttcccctgatagattggaaaagaatgagaccctgcaacttggaatggggaggtatgggaggacactggtgaagctggggtcactgactttgtaaactccaatgaactttttttgccagaagaaacaacttcctccccacccagtagtggcagcattccctccctaacccatgctgccatcagcctttccacctttgtctgaggaggtaaactctgtgctgcctgaggcaatagtgatggcctcccctgaggcagttgccaagcaagataatgagaaataacaatcagtacagtttggctctcagaaagccacatccctaggaaaagggaaagagtactacatcaggggaacatcccatgggaaaaaagaatctgaacaatagccttgagccccagatcttccctctaacatagcctacccaaatgagaaggaaccaggaaaacgattctgggaatatgacaaaacaaggctgtttaacacctccccccaaaaatcacactagctcaccagcaatggatccaaaccaagaagaaactcctaatttacctgagaaagtattcagaagggcaattattaagctaatcaaagaggcaccagaaaagctgaagtccaatttaaggaaaaaaaaaaatacaagttatgaggggagaaatcttcagtgaaatagatagcatacataaaacaatcataactttaggaaataaagaacacagagaaaaacacactgaaaagcctcaacaatagaattgaacaagcagaagaaataacttcagagcttgaagacaagattttgacttagccaaatccaacaaagacaaagaaaaaaaaaattttcaatgaacaaagcctccaagaagtttgggattgtgttaaatgatcaaatctaagaataattggcatccttgagatagaagagacatctaaaagtttgggaaatgtattcaaggaaataatcaaggaaaactttcccagccttgctaaagacctagacatccaaatataagaagctcaaagaacacctgggaaattcattgcaaaaagatcattgcctaggcacattgtcatcaggttatctaaagccaagatgaaggaaagaatcttaagagctgtgaggcaaaagcaccaggtaatctataaaggaaaacctgtcagattaacagcagatttctcagcagaaatcctacaagctagaagggattggggccctatcttcacactccttaaaaacaaattatcagccaagaattttgtatccagtgaaactaagcttcataaatgaaggaaagatgcagtctttttcagacagagaaatactgagagaattcactactagaaagccagcactacaagaactgctaaaaggagctttaaatcttgaaacaaatcctggaaacacatcaaaatagaacctttttaaagcataaacctcacatgacctataaaacaaaaatacaataaaaaaaaaacccaagctacacaggcaacaaatagcacaatgaatggaatagtacctgacatctcaatactaatgttgaatgtaaacggcctaagtactccatttaaaagatacagaattgcattattgataagaatatgccaaccaagtatctactgctttcaagagactcatctaacacaagaactcacataaacttaaggtaagggggtggaaaaagacattccatgcaaatggacaccataaacaagcaggagtagctatatttataacagacaaaacaaactttaaagccacagcagttagaaaagacaaagagggacattatgtaatgataaaaggtcttgtccaacaggaagacatcacaattctaaatatatatgcacctaatactggagctcccaaatttatgaaacagttactactagacctaagaaataatataaacagcaacacaataatagtgggggacttcaatactccactgacagaactaaacaggtcatcaagacataaagtcaacaaagaaacaattgatttaaactgtaccgtaaaacagatgaatttaacagatatttacagaacattctacccaacaaccatggaatacacattttattcatcagtgcatggaactttctccaagatagaccatatgataggccacaaaacaagtctcaataaatctgagaaaagtgaaattatatcaagtactctctcagaccgccttggaataaaattggaaatcaactccaaaaggaatcttcaaaatcacgtgaatacgtggaaattaaataacctgttcctgaatgatcattggatcaacaatgaaatcaagatggaaatttaaaaatttctcacactgaaggataatagtgacacaagctatcaaaacttctaggatacagcaaagatggtactaagaggtaagttcatagccttaaatgccttcatcaaaaagtctgaaagagcacaaatagacaatctaaggccacacctcaaggaactagacaaacaagaacaaatcaaacccaaacccagcataagaaaggaaataaccaagatcagagcagaactaaatgaaattgagataaaaaaatacaaaagataaatgaaacaaaatctggttctttgaaaagataaataagattggtagaccattaggaagattaaccaaaaaaaaaaaaagaacaaagaaaatccaaataagctcaattagaaaggaaatgggagatattacaaccgacaccacagaaatacaaaagatcattcaaggcactacaaacagctttatgcacataagctaaaaaacttggaggagatggataaattcttgggaagatacaaccctcctagcttaagtcaggaagaattagaaagcctgaacagaccaataacaagcagcgagattaaaatggtaatacaaaaattatcaacaacaacaacaacgacaacaaaaaagccatgaccagatgaattcacagctgaattctaccagacattcaaagaagaattggtaccaatcctatcgacgctattccacaagataaagagggaatcctccctaaatcattctatgaagccagtattaccctcatacccaaaccagaaaaggatgtaacaaagaaagaaaactacagaccaatatccttgatgaacatagatgcaaaaattcttaattagctgccagctaactgaatccaacagcatatcaaaaagataatccaccatgatgaagtgggtttcataccagggatgcaggaatggtttaacgtacacaggtcaataaatgtgatacaccacataaacagaattaaaaacaaaaatcaaattattatctcaatagatgtagaaaaagcatttgacaaaaatccagcatcctcttatgattaaaaccctcagcaaaatcagcataccatggatataccttaatgtaataaaagccatctatgataaacccacaggcaacataatagtgaatggggaaaagttgaaagcattccctctgagaactagaacaagacatgaatgcttactctcaccacttgtatccagtatagtactggaagtcctagccagatcaatcagacaagagaaagaaataaatgtcctccaaattggtaaagaggaagtcatacagtagctgtttgctgttaatatgattgtatacctagaagaccttaaagactcctccaaagaactcctacaactaataaatgaattcagcaaagtttcaggacacaaaattaatgtacaaaaaccagtagctctgccatactttaatagcaaccaagctgagaattaaatcaagaactcaaccccttttataatagctgcaaaaaaaaaatacttaggaatatacctaaccaaagacctattcaaggaaaactacaaaaccctgctgaaagaaatcatagatgacacaaacaaatggaaacacatcctatgctcatggatgggtagaataaatattgtaaaaatgactatattgccaaaagcaatatacaaattcagtgcaattcccatcaaaataccaccatcattcttcacagaactagaaaaaaaatccaaaaatattgtatctatatatctatatatactatatattatatatctaatatatctagatatatatgtattatatatttatggataacatatctccatatatactatatatagtatatgcagttatgtagtatatataactatttataatataatatatggatatagtatatgtattattatataatacataatattacattatatattatataatgtgttatatacaatataaatgtataatacccatatattatatataatatatccatataatatagtatatatattttttatatatatatatatgtattttttgccacactcctgtgcctttcttcattccaagctcatggatatataatatatctatatatctctatatctgtctatatatatatcatcttccatgaagtccgtatggtatgggagggagacagcatgagcttggaaggaagaaaggcacaggagtgtggcaatgtatattacatatatataatatatatattatataaacataaatatatataaaaaagaattttttatattttttaggtatatactatataatacatacatagtatatattatatatatatgcatatatatatatatatatatatatatacatatatatatataatgaaatactactcagccatgaaaaagaatgacttagtggcattcgcagcaacctggatgggattggagaccatcgttcaaagtgaagtaattcaggaatggaaacccaagcatcatatgttctcagccataagtgggagctagggtatacattggtgcaaaggcatgagaatgatacaataaactttgaggacttgggggaaatgatgggaaggaggtgaggaataaaagggtacaaagtgggttaagtgtatactgtaagtgttaagtgtatactcctcgggtgatgggtgcacaacaatgtcacaaatcaccaataaagaacttatatagaaacaacaattatgacagctgtaatttctaaagtgattgtgttaggtcctgtgcactagatggataggacctgggatttaggatttatcagtccagattcactttaaagaaaaggatgctacttgtattagttagcatttgctacagtaacaaacaccctatacatcttagtagcttttagtcatgcatattttcccctatgggtctgtgtgttgctagtggccatgctaggctcagctcaactccacatttcttgttgttctgggtcccagtctgaaggtacagcatgatctgggttatgcaagtctcatgcagaggggagaaatgtgagaatttctgatgaaccgtagaatcccagacactcacatctcgttgaccaaagcatatctcatgagcaagccaaagtcaatgagaggtggatacatattcttcctcctaaatgcactgggaagtcacttgaaaatgaatggggatttataatcctagaatggaaagggagtgaattgctgggaacaactatcccatctatgacccactgtattttaagcacaaggggatttattacatggaaatgggcgttcacaaaactgtcagaagtgttgaagatgtgggatctaggactgggtctgtatcctcttatgcctttagaaaacagcaccccacaaggagactgaaacagatgctgagtgccaatttactcataactacagcaaattaattcctgggaagaatcctataaggttgggatgaatctcctgaagctgctgatgatcagtagagcaatctgttaaagaagctctcacctgtgtctcttctttcttttacaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggtaatggggtggaaaagaggcacagagtgagacaattttgttgacttttaaaattcatccattaattcagtaaatatttgttaagtacttattacatgtaaggcactgtaataagctatggacaagacactcgtcttccatgaaggcagtatggtatgggagagagacagcatgagcttggaaggaagaaaggcacaggaatgtggcaacctggtaactcccaggcagccaacacacagtttgtttacactatatgtagactgcacatgctctgttgtgacctcccagggtgaaatgaggacttttggtctggggtcgtagaagaggcgggtttgaatctaataatagcaaatcaagcctgggcaacacagcgagactctgtctctaccaaaaatgtttaaaacaaaattagccaggcatggtggcacatacctgcagtcctagctactcaggagattgaggtggcaagattgcttgagcccaggagttggaggctgcagtgaactgtgatcacaccaccacactccacagagtgagattctctctcaaaaaagtggggggcaaatcagcactgaacaaagactgagtcttcccagaaagttaggtcacgtgtccctgtcaatagaggtgtgcaagtaagatagctacgaggtgacagttatcaaaagggcttcaatatgagacatccaagaaagaaaaagatgaagaaatttctgagtttccttcccagccctgagcgtctagaattttaatccattcactgctgatccatcaattgccttcacctgaagtcctatgactctttctgtaggatggaaggattcattctggctagggtaggggaaggggtggagctaccagcgtgaacttaatacattggtgctcaaaaagagtcacgattatgacatgatgtcctaagttccctacactatgaaacagtcttagtgtggagattgcaaatgccttgcctctaggctgaagacggccctaggtgtgggtactcttaaaaaaaataaggttcaacattttaaaattgaaaattttcaaacagaaatttagatttctggattttttaaagttatacttcctttaaatattgaggaaggccctttaaatattcaggaaggcccttactaccatgactcaccattctgaatccataaaagtaaatttgctatataaacatcaaaaaatatttccattcacaaataacaccattagcaaaataaatgactaatgaaaaccatggagaaaatattcaactcatataacagcaaaaaagttaataatataaagtgagcttgtagaaaccaagaataaaaaggtgcaactcattataaaaccaggcaaagtatatgaacagatagttcacaaaaaagtgaactcaaatggccattaaatataaaaatttctcaccctccctcataataaaagtaatgcaagtgataattttgctgaaataacttttatgcacctgtcttgttagtcaaatacaaaaggttgtttttttctttcagaaaaaatagtttaattatcacaagacatcttagtggaaggatgggaaatatttctcaaatctgcccccttgaaagctcagagactagggttttcaaagataatttggagggcagggggctaaggaatgggtgctactgattgcttaggaatgaaattatagagatgtgagaaatgtcttcaagtgctgagtttgtttctgggtgaggcagacacaggacaggtaaagtcagttccttgctgtagaatcacaggtctaggtagtgtcagtaacttttccagaatgcaaatgtctgaaaaatatctcaaaggtcagtcttagattttacaatagtgatgttaactacaggagcaactggtgaagttacaaagtgtgacttctggttacatgactcctaagcagtaagcaagctagggaacaatggctggttattgcttaactatgcttatagcttagcagaattgagacccctaccatctaccataattctaatgctgtggaattgcattaatttcacaaaggggtttaggtccctgaacaagaagggagttggtttcaggaagagactgttgtcatccttgctttaaagttaaattataaactaaattcctcctatagttagcttggtctatgcccaggaatgagcaagaacaaaatacaaatctttaacaactctattagcaaggctgtgaggaaacagacactctcatgtgttaccaaaaagtgctataactctgatggaggcaaattttgaaatatctaataaaattgctgacatgttttgtttttgattttgcatcattactctcaaactatgatctgagaacccctgaggatacatgagactctttcaggggatatgcgaagggtctattttacaataaaacagagaaattagaacccttatgcatcatgatgggtatgtaaaatgttacagctattatggaaagcaatataacattttctcaaaaaattaaaaaatagaattcccattcagcaattccaactctgggtatacaccaaaaaaaacttaaaatcagggtttctgaggaatatgtgtacactcatgttcacagtagctttattcacagtagttggaaggtcaaacagcccaaatatctatcaacaaatagacaaaaaataaaccatcattctcagcaaactatcgcaaggacaaaaaaaccaaacacagcatgttctcactcataggtgggaattgaacaatgagaacacatggacacaggaaggggaacatcacacactgggcctgttatggggtggggggaggggggagggataacattaggcgatatacctaatgttaaatgacgagttaagctgtgcagcacaccaacatggcacatgtatacatatgtgacaaacgtgcacgttgtgcacatgtaccctaaaacttaaagtataataataaaaaaagaaatatcaggcaaatccaaccaaaaaaaaaagagaatattgtatttttcaatgtgagaaggacatgagaattggaagggcaggagcaaagtgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgtgagccaattaaacttttttctttataaattacccagtgtcagatattcctttatagcaatgcaagaacagcctaatatagtaccttatataaatgaaatcacacagtatttggttttttgtgtctggctaatttcacttggcatgtcttcaaggtttatccatgtaatatatgtcagaatttccttcctttttaaggctgaaataatattccattgttatgtatatgcaacattatctattcatcaaacattcaggtcaaatcttgaatgctctgttgcttaaaaatttcttctctcagattccctaagtcattactcttacgttaaaacttccacagatcactaggctatgaacacaatgcagccaagttctttgctaaaatataggaaggaggacctttgcttcagttcccgaaaagttccttatttgcatttgaaatctggtcagcctgcatttcattgtccataattctatcagcattttggtcacaactatttaaccagtgcctaagacgttccgaacttttcctcatctttctgtctcttctaagccctccaaactcttcgatttcttcccatgacctagttccagagttagttctacattttcaggtatctttacagcaatatcccacttctggtaccaattttcggtctcagactgttcttgtgttgctgtaaaggaatacctgagactaggtaacttacaaagaaaagagatttaattggcccaaagttctgcacagtgtataggaagtgtggtgctggcatctgcttctgatgagggcctcaagaaatttacagtaatggtggaagatgaagaaagagcaggcacaataaagggcaagatgaggagcaagacagagagtgagaaggtgccactcacttttaaacaaccagatcttatgatctcatttatcaccaaggggatggtgctaagccattcatgagggtcccacccccatgatccaatcacctcccaccaagccccacctctgacattggggattgcatttcaacatgagacttggagaggacaaatattcagacaatatcatgtatctagaatagtcaaattcatagagtcggaaagtagaatggtgtttatcagggcctaaagggagaggggatgacgggtgattgtgtaacggggacagagttttcattttggatgatgaaaaactcgggagatggatggtggtgattgttgcataacaatgagaatgtacttaatgccactgaactgtacactcaaaaatagttaaaattggaaatgttatgtgtatttttactacaaaattaaaaaaagtaaatagatagagatacatatataaataaatctaaagtgatatttgcctttttattctaattctttcacgagtatacaatagcattttccagaaggtacatgttggtactcacaacagagtgaatgcagaatcagatgagaggatccaatgtttttctactaagacgttaaagggaattgcagaataaatagacgcaataaataaataaaataatgccactttcctcattattttttcattttgaaaagtttactttatcattataaaaaaattatgcatgctaatatataatgggtttattacagttatttctaaaagcatacatttacaaaaattctgttttaatatctactatggtagatattgacagatataactcatataaataacaagtctttagaattttcaataccttttaagattgtatggaggtgctgagataaaaaaccttactaagcaccaacttggcaatcccaagacttggaatttatcctacctgcttgtgtaccaatgccccctgatcaacagggcttctctttcctcaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggttggtaactgactacctggacagagaactgtcttccttgtgaagaaaactgatagcagagaaatgcagccacctctctcaaaagaagtctcctccttggagcatgctgtcctgtatcatatgaagaaagacatctccctacttccacttatttaagcaaactatgtgccaagcacttatgcagggtgaacaacaacaatgacatagtttacatattcatgggacttacagaactttggagaaagctcttaaactattaattgcacatgtaagtatttaatcagaattatgataattggtatgagaattctattaaaatctataaaaataaatttggcagactgtgacctgcaggccaaatcctgcccaaagcttgtttttgtaaataaagttttattataacacagtattatatgtggctgcagttgcactacagtggcaacttgagtagttggaacaagagagtgtcttatccacaaaacctaaaatatttactatttggccctttgcagaaaaagtttgccaatgcttttctaaaagaagacttgaattaaccaatatgaggagcaactaagtctcaatggaagtgatatttgagctgagatctgcaggatgagtaggattttgccaagagatagagaggcttgtgccaagcaaagggaacagcatatgtgaagatgtaattatctgatgatttcttcttgtccacttcccagaaaagccaaacactgaaaacagtaggagttgtggtagagaagagtttaataattgcatagacagccaagttgaaggatggaggatgtttcttaaatccacctccccaggaaatcagagactagagtttttcaaggatgctttggcttccaaggggctaaggaatagtaaatgctgattggtttggctggggatgaaaacatgggttgaagctgtcttcttgtgttgagtcaactcctcagagatcacagaactagttgagttagtttcttggtatcagttactgatctgggtagtgcaagctggtccatcagaatgcaaggtctgaagaacacctcaaataccagacttagggtttaccataatgatgtaatctataggagaaattggggaggttacaaatcttgtgacctctggctccatgactcctgaactataattctaaccttgtgacaaatttgttatttttctaaaggcagtttcaatctccaagcacggacacagttagtttcaggaaagagctattatcatttttattttaaagttagactataagttagatttctcccatagttagcttggactatgtccagggatgagcaaagatagatagcttgtgaggttggaaacaagatgaagtcagctatgtcagatttccctcagtgtcataatttttccaaaggcagtttcaaagccacagaggagggaaacttgaaaattataaaagaacctaaaaggatatctatgtgcctgaagtccaggccataaaagaaagtagtggcaatagaatgaacatgtagaggtggccaggtgctaaactggcagtgccttgtggtccttggtaagagttgtggacatttatccagtggtgaatgggaaatgattgatggattgagtgacactcaaaccattgatgcattgagtgacactcaaaccattgatgcactgagtgacatgatcctcctctgtttggatggtcatattggatgctcaatagggaatgggatgaagaagacaatagtggggttggaaatctcagataagaggtgaagcgatggtgatggcttcagtttcgttgaggtagtagagatggagataagtggatttaacaggcaattggggggtgaactaataacagggttattcaaaggagatgcgagggagagagagagaagtacagacatttcagcaagtgggtggatggtgctttctttcactggagtgaagaacacagatatagaaagaggtattagtgtgttaggaaaatatcacaagttcaatttgggcatgttgagtccaggatgtccatgtgatgttcaagaagtgataacaagttggatttaaggctctaaaatttgacatggagacagaaatttgagaatcatcaacttttacattaaaaggatgagaagtacagtggtatcaaaaagaaccccaagaaactccagcaacctccttcacaaactgccctttccacctctgcttgcacacagcctaatcccaactaaaagctccaacccacctcatattctggggacaatgggctgagcatgagaaagcaatgggtaaagagaaagacatgaatgcagccaggaattagaaactatcagaggcgaccaaaccaactgcaggaacttggaagcctgtggaaagagagaacaagccagagagaaaggtgacatactgaaattatagccagaaggaaaggagaacccagaggaagagatgtgtctattgttctgtgtctgactcaattggccaccatggtagagaaacatttgaggatatttacaggtatgcagtgagaatcccaaagtgttgagagtgggaagaaagtgagctaaggttaaaagctatttaacaggacaggcatgtggtttaagcttcacaaaaaatgaaacctgtgtagttattctgttcttttctttctttcttttatttttttgagacggagtctccctctgtagtccaggctggagttcagtggtgcaattttggctcactgcctcccaggttcaagcaatcctcctgcctcagcctcctgagtagctgggattacaggcgtgtgccatcaagcccagataatttttgtatttttagtaaagctggggtttcgccatgttggccaggctggtcttgaactcttgacctctaataatccaccctccttggcctcccaaaatgctaggattacaggcatgagccaccatacctggccctaagtctagttattctacagaatattttaataatcaaaggagtctcattaaaataggaaacaagaacaagaatttaggaaagtgataatcatggggtataaaacctcatttatgtgcaaggaataagtctaatgttttaagataaattgtacagcatgctaaacacagctaataattcagtactgtaaatttcagtatcattaagagcaaaactttctaatgttctcatcacaaaaaaatgttaaatacttgaggtgatggatatgtgaattagcttaatttaatcatctcacattgtcttcaaaaattataataccactttgtacccaataaatatatacaactatactttgtgtgtacatagatatgtaaaactgaaggcactctcatctaagaaaaatgcatttaatgtcccagggatgaaataaattgccaggacctagagctattggtgtttcaagaccatggacagttccaagtgcctttcctcatgattctttaattatcatatgagagttttgaatacagcaaactcctgtagaaaattttttttgaggggtgagagtgggtgaggagaattgtatgtgtcttagactatcaacaatgtgacattagcaattcaatttcttttctttgtctcagtagggcccttaagactctgacaacccagggaatcctaggtttcattcactcccttgtccttagttcccttttttattgacactctctattggtcattacttcctcatcctctccttccccacttgctcgctgcttgatgtttatctcaggcttctctagggacaaagaaaatcatcctttccaattctctaaattgttggcttctttaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaagtgagtatctacatgtctcagcctgggttttaactaaaactggaaacagagccaagcacttaggtgcaggtgctttattgaggaggtgcagaaagaacagcatgggactaggaagagtgaagctgggaagaaataaaagctaacacaagggtattttttttttttttttttttttttcaaatcattgcaaggactaaatggggcttgatctgcctggaccttctgagcagcatatagaatgcctcccaggattgtcctctaaaggattgaaaagcactgatccattagcatctggtccccacaggttcagggttgtcctgggggtgttattgcctccacacttctgggctgcgcactcatgcgtgaagagtggctcagagttccatgctatggtaaaacagagaaactatggggcacaaagtgaatcacttgtgatgcacactggaaacaacatgatgttaacaccaagtgggttgaaacccacccagaacaatttactggaactatgactcaaatcaggggtgaggccaaggtcatgagggaaaacccaagagatggctgatataccaagtttctgggctcttctttccacctcttgtatctctaagagaggctgatcaagggcagaggactttccatgtgttgatagcatggaaagaccttgatagtccttccaaaagccgatagcaagactggctggattaatgattttctctgtcaacatgtctgaaatccctctagcaggggcacatatgataggaaacttgaagggataacttcagcttttcctttctaatgccatggtctttaaggtagctgtcatggaaataaacaccatcatgcctgcttttaaaggctcaaaatcaggacactggagatgtccaagagatatgtaggtgcttccagggaatagaagagaatgccaagaaagtacttggaaaacttgtattaattccacccctcctgtccacttggtgtcatgccagagctcttcacaacaattagattagcatttattgagttcttactaagcaatttgctcatttctttggtggtagagataactctataagacttgatctcactttttttgcagatataaagtcagacacagagacgttaaataagtagtttaaggttgcattgataacaaagtgtgaaacttcagtagttttcaaacccaactctgattgactcagactcccatgatcttaatcactcagcagcctctcttgtgaggtgggtccatcaacttgcccttttcagcacagtgggtggtgggaaaagatgggtcactttgatatctggtgtccagtctagctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctgggtaagctgagctctttctctctacagagaattacatgagttttggagttagaaggagaatgagacccaattatatattaagtcaggtcaaccggggtcccaccttctgaacattcatctcctgttgatacaggatgtgtggatagaacaacttttcttcccccttcctacttatacatagacatatgcctataaacctgcaggcagatacacacacacctctgcacacacacctccctttcctcccctacaccttagtgtcccacgcatcctaagcatgcacccacctatatgtacatgtgttttgtctgtgttttcagttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaaggtaagagaggatccagtttgcagcagttattcagagtgagcccgaggtttgcacacttcaatttattgtagtttgtttcaattcatctaatttttgctaaacccctgccatgtggtgaacagtgttcagtaaacgagatggaaatggtccctgacctcacagagctcatgttctggggtaggagagaggcacatatatagataaaaggagtatgttcaggagaaagatattgtaggtcatttgttcactcaacaaatgtaacgggctcttccgctggtgtcacctatcagatagatgctggtgaaccacgtgtaaaagggaaagctggagtattggaggggatgccatctcgctctcatgagtgtgtgtgtgtgtttgtgagtgcacatttcatttccttttttatttgcagcataacacacaaactgaaggtaaagtacacagagtgccaccatcctatgtgtacagtttgaaaataatttagctgtgttagatactgtcttagtcagcttgggctactataataaaataccatagtctaggtggcttaaataacagacatttacttctcatagctctggaggctgtaagtctgagatcagggtgccagcataattggattcctggggaagccctctcttcctggcttgctgatggctcccttactgctatattctcacatggttgagagagacagtgctggtatatcttcctttttacaaataaaggcactcatgctatcactggggcacctgcttcattaccttgcataattacccctaaaagccctgcctccaaataccatcaagttgagggttagagctttaatatagggatttaggtggggacacaacatccaattcatatcagacacccctgtaaacaccaccagataaagacatgaaacattcccaccactgcagaaggtgttcataccccttctctgacagcatctgccccccataagttaatcattcatttgatacctatcaccatagattaattttatctcttcttggaatttcatgtaaatggagccaaattatatgtaatcttttgcatttggcttcttttactcaaaatattctctgtgagattagtccacgtgttgcatgtatcagatgtttgttgttttagctggctgcaaagtatttcattatgtgaatctgtaaaaatgttcccccatcctattgttaatgaactttgggttatttccaatttaagatggttttctagaagcaattcagaagaataaatggaattttttcctgtagaacttgatggtacagccattaagtaagacccacagactgcagctatgcattatcctgtagcaacaaagcaatgaaaatgacctcattttgcttatgaagatacaccctatgttggactctatgatagagggattgggttatttccctgctgtgcccccagatctctaatggcccatccagacatctatttggctgcagcaaaggttcaagctaaggcatagatgacatcttcaaaagtcaaaaagtcaggtgtgatctggattttcataggaaattatcttcaaataatactgtcattctctgttttaagcaaattcttactctgtgtccttctcaaaaggacttgaactggtttttattaagttccaccattaaaaaaatgaaaacagacataaaattataaagcccattgggaaaatttaggttggaggtgtagggtggaaaagactaaggaaattaaggagaaatatagcaaatgagtatgtagttacaagctgagcttctagtaaggcaaagcaataaggaatatgggatcattttcatagcttatatctgtgtatcaagcacacttgaaggaaattattgcatgatactcacatttgtcattttttctagaccttttgcttaaaccattgccatggtttgaatatttgtgccccccaaaactcatgatgaaacttgtaaaccaaaaataaaatcctaaggccccatcccgccagccatctgaatggacttcctccttagccagggttcttttaaaatttaacctgagagactgtttcaggccatgataggaagtgggagtgggacatgcctcattatacctctctggtattaacatcaatacagactttaagtctgattaaaaaaaaaagattacaacctgttctgtctaaagcctagtgccagtacctaaaagcttcctctgcaaataagaacttgggtctccacaattatttatcttaactaaggcattcctttctattgatcccaggtctttagataaactcaaccaattgtcaaccagaaaaatttaaatctacctataagctggaagcccccgcttcaagttgccccacctttctggaccaaaccaatgtattttttaaatgtgtttgattgatgtcttatgtctccctaaaatgtataaaaccaaggtgcaccctgaccaatttgggcacgtgttctcaggacatcctgagggctctgtcatggccatggtcactcatgtttggctcagaataaatctcttcaaatgttttacagagtttggctcctttcatcaacaaactcaatccccagtgtaacagtagtaagcggtggggcatttaagagatgattgggcctcatgagggattaatggattaatgggttatcctgttagtgggttagttttggagagtgggtctgttatataaaaagccagttttgctctacctcgtgagcccctttacaatgtgatgccccgaccctccttgggactctgcggagtccccaacagcaagaaggctctcaccagatgcagcttcttgaccttggactttccagcccctagaactgcaagaaataaatttattttcttcataaattactcagtctccggtactcagttacagcaaaagaaaacagattaagacaatactctattacattctgcataaagaaaagcatgggatggagatggtgttatacgacaggaatacatgctgcaaataatgatcccactacttgctgactaggtgaccttggagcagctacttaaccttgtacatcatgggtttcccctctgtatcatgaggatgatagcacacactccgtgaggttattgtaaaaattaaatgagataacacaggacatggcaagtattcagtactaggtctttttgcagcacttgttttgaaatgtctatagatgtctttagcttttcaaagaacttttatatctaaaatatattccaaaaatattttcaggaaaataaggctggaaacaatctattataaagctggctacagaaagttaaggaacttaaccaagacagctgctgtgctcaggcagctgatcttcccttagttgctggggggtgatctactcctaggggtgtgttaacgagggcaagtcttaaactggcaggaacagacatccaggatttgacaaaaatgtttcaaattagccttagactttttcactacaataatatgtattcatttccctgttatttgtgtcttcagggtgcatgagagttgtggggctcatttaacctgaatcagacatagtaaacaagctagggttttcatccagacctctacaactccatagctcacaattgtaaccactgtgcatagccataagttggcatttgacctggtgaccaatgtctcacctggctcttgtcttccagacactctccagttatccaatcaagagtatgatgggtgcccccattgtttaccggatgttgctacagcaggatctttccaggtgatggggctttgaggattggtaagagagtctggccccatccccctgactccctcacatacattcatgcctatctatctgaatctctcgcacacagagagccccatgaagccatttgcatcatcaaagcacccagaaacccagtctaggcctgagtggactttggttccagggaggctgagggcaaacatttatttctcttcttcagttacaagttcccccatctacagaactgcgtcactgtaggggagtcccttcttccagaaactctggagaactggagggcccagacaggactggacatccgagaatcctatggccagacagaaacggtacctgttcccaggggaaccatgggctgtgtgcactttttgggcttcaaaattctctttgacaataaaaattgttagccaccatgtatcattcatctattcgagaagtatttattgagcctctatgaagggacaggtactgagtattgaaaattccgcacagaacaaaaaaggcaaagttcctgttttctgggagattacattccagtgagatttggggagagagaaaataaactaagaaatatctagcatggcaggtggtgagaaatgcgatggaaaaagtaaagtagatgacatggggtgagaagttggtaaatcagatatggtagtcagaaaattcctctgtgatggggaaacattttagcagagaccaaagtttatcaaacatgtcaagcactgtacaaagctacttagactgaagtgaggaatgggaagaagaacccaccatgactttactgcacctcctgacatatcttcttggaactcttgaggtctcatgtgcacaatgtggatttatgctattctatactattttacttatcaaaactacatggggaatacttttccccaactcttcttctcctttttccagtgcctcttacttgtgactctcagcacttcttgcctcttcctctccactctcttaccctgcatccttctttggctaatgagtacccttggaagaacttttgcagaaggttgacggcagctctgtggtatgaaagagccaggaagagctctgcaaatatgaataaggacaatggagttgtggcaagcataccctggcaggggcctcccaccattcagaggaggacatgtttaggatatgcttacaaggacactcaggttcccatgatcttaatcactcagcagcctctcttctgaggtgggtggataaacttgccctttccagcacagtgggtggcgggaaaagatgggtcattgtgatatcttttgtccaggctagatctgagaaaatgacaatctatgtctctgtcagtgaggcatccaccactcatttgttattctgttgggaaggttcatttcagggttcaagcagaactggtgctgccatgggagatactttaaaaagtatattttactgcttgaggaaatggatacttcattcttcatgatgtgattatttcacattgcatgcctgtatcaaaacatctcatatattccataaatagatacacctatgtacccacaaaaattcaaaataaaaataaaagtagtatattttaggccttacagattgcatattggtgatcccatatagtttgaaagggctttgggtatccatagtgtcgtattaaaatgtggttccccctaaaagagattataatgtgattgttaggtcctcttcctggggagtggtagatgggttgcttcctgaactaacaatttagcgaagcccctaggattgtggttccagtaatggggagagagccagggaatgaggagcagggggagccaccaagtgcaggccaagttcaggacagtgtcaggacctgctctgcagaaattttttctttttctgtgaccttgtacctcctcctgaggtttgctgatctgtctgcttctttccacagggattaacttgcatggtttccaagacaatgaaaatcaaaccaggatacatgggaacggctgcttcctgttatgatgtacaggtttgctcgggacactgaggagggaggaagttaggggaaacactgattttcagtgatttatgttttccattgtttattgagtcaaaaataatagaaagtactgatattaagataacataagaaaaaaaggaggtagggaggttgggggaaggaaagagtgagggaaggaaggaggaaaaggggaaatgatttatattcttaccatccagaaggacccactttgaatagctagcaaattagctagacagtacacaagtatatatgctttaaaaacagaaatggggtgaatcttgacataatattttgtaactagcttttatcatttaacaatttaggtaaggatcttttcagttcaattaatgccaacctgcagcatgatttttaatgatgtagtaaatagtatatatccactgctgtttatgccttttattggaccaagggatgatgtcccagttttcactagtaaaaatacactataatgaatgtgtagtagctaaagttttattgctttctcttgttgttttttgagaactagaatttgtgtttgtgtatctgtgttatgtgtatagttctgtatatctaaagtgtaacttagactctattcagtgtcatatccagttacttgccatgccattcactatgataaccatttgctaagcccctttcttagtatcttatttcattcctataaaaatcctgtgaaataagctgtcagtatctgttttatgggcgaaagcactgaagcccagagtttaagtagttcaaagtcagctagtaaggtagcagagtaaatttgagttttgatctgcccgatttctaagtccacaggtgaggcaggtctcaaagataagaggaggctattactttatctgagctcctagagccaaaagcatctccccaggctcatctgggccagtctcaataaaaggattcacctaaactattccaggcagatagatcagagatctgagtttaagactcttgggttcccctggcttctggttgttgttttcagtctccactagagcaagagggtctttcatttgaccaattcagcaatctcatgatgccattgaagccatctcctgctgtgtgcatcattcttccaatctgcttctttctccagatcatagatgataagggcaacgtcctgccccccggcacagaaggagacattggcatcagggtcaaacccatcaggcctataggcatcttctctggctatgtggtgagaaactgtgctcctcctcctctgttccccagtgaggatgggagcactaaacgggatgagggaggacaaatgttctgaaacttccaagaggcactagatgtggagacaaagactgtccagttttcaagaatgtatgctttgccagtggaagaaaagtggctattcagccttgccatcctcagcctatcactgtgatctcattggaagacttatttttcttcagttagcccttagactcctcaagaactctctgtttcatgcccaaaatattattgaccctgaactatacacagcaccattcccccaagggctgcctttccctctcccctaggtatcatccccatgctctatgccattgatcttctttagagccatgccaggcactttacagtaagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaccccaagggcatgccttctgatccctgagagaattgattaataaactaaataaacaataaatcaaataataatagtttctaccatttattgaatgcatatcatgaggcaagcattgtcctataaacacatttaatctttaaactttaaactcatttaaactttaaactcgtttaatcctcccagccaccctataaagtttttggactcagtttgctcgagttcaaaaccctgctctactatgtattgcatgatcttagggaagttacctatctgtcatgtctcagtttcctcatctgtaagttgtgtgtcgtgagtgtgttaaataaaagaattgttgtagatccaaatgattattcctattatacagatgaggaaaactgagcctcagtgatcagggcagagccacactgtccccttctccaagcatttcctttgtgtggtcccactctattctcaaatgccagtgaagtactatgtcatgggcttctccccatttgacagaaaaggaaacagactcagaagcgtctgtggggcagactcctaaggccacagaggctccatgatgcccatgagaaagtcaatccagtggccaagaaacctggcttctggtctcagttctaccttctgtaatggctgtttagcttcagactaacctcttgatgtctctggtcatcagtatccctatattcccaatgatagagtgaggctaagaatcctttatgccaccatatataatccagtaactgaacttccagtctggagcccatgcccctatacctgagtcagataggaagatgcactgacaagggataaacctcaagccttttcattgcttataagcaagtgcctcagctgaatagacggacccagctattgtagaaatatgcacattagccagggtcccagggggcttcctggctaatgtctctagaactttcaaatttaacaaagaagctaagaaaattacctaatcaaaatgatagctttgagtggtgctatggagtgagcagagattaggatatctatgaaaggagagatggaatcaattggggaaaatgccctaagcatggatgaatgaatacatcaataatatctatcagactggacctagaggagtagctgagagaccctgggtggaataacttcaataaatgggaaagatccagttctgcctgtggcctagggttggctggttcagggcatgtctgccatgttcaggttatacactgcacacctgcagttttaataagactcatagcatttgttcatggcagccccagggcaggggatttaggctttgcaggcacaatgactctgtctttctgtggtcaccaggacaatcccgacaagacagcagccaacattcgaggagacttttggctccttggagaccggggaatcaaagatgaagatgggtatttccagtttatgggacgggcaaatgatatcattaactccagcgggtgagcttggtttctgggttgggaagggaaatctgggtctttactctggctggttccagacttctggaatggcctagaggttcggtgtccagtgttctctgaaggacaggttcttctgcaggtaccggattggaccctcggaggtagagaatgcactgatggagcaccctgctgtggttgagacggctgtgatcagcagcccagaccccgtccgaggagaggtgatggggaagcagtagcctgggggtgaacacatatgaacacaagggcagtgtagtatgatggtttaagaacagggactgtggggctgaacactctgagacccaatcttggccctgccacttactagctatgtgaccttgggcaagctacttggcctctctgtttctcagtttccccatctgtaagatgagggattgttatgagggttaaatgtgctaatatttgtaaagtacttaagtatggtgatttctaaaaaaactaaacagaactaccatacgatccagcaatcccactactgggtatttatccaaaggaaaagaaatcagcatatcaagaagatgtccacactcccatggtaattgcagcactattcacaatacgaagatatgggatcaacctaagtatccagtggatgaaaggataaataatatgtggtatatatacacaatggaatactatttggtgttaaaaaagaatgaaatcatgtcatctgcagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaacttttataaagtaaagtgcttggttgggaggccgaggcagatggatcacgaggtcaggagtccaagaccagcctggccaagatggtgaaaccccatctctactaaaaatacaaaaattggccaggcatggtggcaggcatctgtaatcccagctactcaagaggctgcggcaggagaatcacatgaacccggggggcggagtttgcagtgagccgagatcgtgcccctgcactctagcctgggtgacagagtgagactctgtctcaaaaaaaaaaaaaaaaaaaaagaaagaaaaaaaaagaaaaaaagaaagtgaagtgcttggaacaaggcctagcacatagtaagtactatataatgtctattttgatgaggctggaaggattctatcctgctgtttggtatttgaatcagagtctgattcccgaccagaagaacagaggagggatttgagccaaaggacagagcccgtgtgccacagagttcgcagtgaaaataaagggaaaaagaaagacccctataaagccaggcttatagaaataggctcagatggggtctagtggactttgatgtgtgtgtaggaaaatattaaggtgggatgtgtggatcagtgtcctagcacattcccgcagggtgtaagcctggcactatcatacctctggtacgtacagaatacatcatacagaaaattatgggaaccactgagcagtgaggccatgggggatcccctgctgagaaaatcctgtgtgcccagctctgagctagccctgctgtatatgatttcattttatttaccgtaagttaaatttggcaattttatccccactttacagatgggaacactgaagtttggagaagttaacacattgtttagggttatggttttcagtctatttttctcttttctccccctgtatcttctttctccttatctgtctctattgttattggagtatgaggtgagcctagtctcaatcttttgtccacctgctcctccaataaatgacttcagagagagctgtaacctcattcatgtccccagttttctccttttcccttgacctggatcaccgggggtgcaaatgaggagatacaagggtgatggaagtcttaatgccaatttcacattattccaggagatgactacacactctaatcccttctctctggccttcatcttttttgcaggtggtgaaggcatttgtggtcctggcctcgcagttcctgtcccatgacccagaacagctcaccaaggagctgcagcagcatgtgaagtcagtgacagccccatacaagtacccaagaaaggtaaggcctttgagctcccaagtcactcaaacttgagaaatagattgttttcctgttatatttatcttcttcaggaggaggacagtcctctaattttaaaaagtcttcctggctgggcgcggcagctcacgcctgtaatcccagcactttgggaggctgaggcgggtggatcacctgaggtcaggagttcaagatcagcctggccaacatggtgaaaccccatctctacccaaaatgcaaaaattagcccggtgtagtggcatgtgcctgtaatcccagctactcaggaggctgaggcatgagaatcacttgaatctgggaggtggaggttacagtgagccgagattgtgccactgcactgcagcccaggtgacagagtgagactctgtctcaaaaaaaaaaaaaaaaaaaaaaaaaaaaaaaaagtctttctatgatcaagaaagcccagaaagacaatctagcttgatgcctgaaaaatgacctcagcttttgactcactctgaattaaaagccaaatgctatcaagggaataagttctagccagtatcttacctgtattcccattctctgcactgggttcttgctatagtattcagggttgtgcaacgctcagttgcaagtgacagaaatctagcttgacatttattgctcatgcaattgaaaagtccaggggtggggaaagctttcattatggctagtcccaggcattcctaggatgtggtcaggtgtctctctttcaccctttgactctctttcctttgtagtggtttgatttcttggaatgctttttctttgtggctctatcagctccaaacatatattctcagcagcttagaaaactccagtagaaaatgagcatgtttttctccaaaggcctcaacaaaattctctgggttgactctcactggaccaacttgggccatgtgtccattgctaaatgaatccctgtagccaggccaatgtcacactgattagccaagtcatcctcagagaaagtgcaggggggatgggggagagagctgccctaccccatgacatggactgagagggaggggtggctccccacaggaaaagggaagtgttcttacgagaaaagacaaaagcatagttttcagcttctttcattctgggacagagaactgaggcacagaggttgacaaggcaggagaacccagttattggatttgggtcccagataggagcttgtcccagagaaagaaaaaaaattgagtctagggtagaaggtgagagcaactatgctgagcttagagtcccttagattcttatgtagcccagatgccacctgcctttcctcagcacaggctaattgtcataggtcttctgagaagcaggccatggggaaagaggttaccacgcaagaggcttattagggagtgttttggaatcaacccctgggggaagggagaggaagggaaagaaaggagcagaactgagcagacggtgaggttgcactgtgacttagtctcaatgggaactccagccaatcccatgggagttctggagctagtataacctttcagtgttgtcctaaggcaaggtgaggaagggaagggggtctttacagtcacaggtggatcaggtatagatgtgtaggctgccctgggaaggagtgtgaccttggacaagacagctgtctctggctgaggcaatcctcatattggtctggcagtggggtgggacttctttgtccctggaggaggatctcagctgcatatcagagtccaccacatggacttgcagcctctgagaatgaggcagcatagcacagtctcaggaatcagactgttgggttcaacgttcacctccaccagttactcaataacctctgtgatcctcagtttccttatttgcaaaatgagaataatgctgttaccccttcacagattgttaaggatgagttcatttaagaaggcatcagacacttagaagagtgactggcacataataaacatttaataagtatttacaaaggagtttagaaatccaggcacaccaaagatattacgaatgtttaagtataactgaatattgtagaaggctgagtcaaggagtcctaccacacagtgtgcagtgtcttactcaaatatctcaatagatgtgtctctttctgcaagtctctcctctagaattctcaaggcagcggattatttgcaccttccccctccttccaccaactacatccagtcctttctacttctctcttcatgacaagcagagtagcttccttcttagcattaaatctggatacctcctgtggctttcatccactctctatctacccttcggggcccaaatagtaaatattttaggctatgtggtctttgttgcaactactcaactttgcccatgcaatgctaaaggttgacagtttctaaatgcatgggtatgagtgtttcaatgaaactttattgataaaaacaggaagtgggctgtattttgcctgcaggccatagtttgctgacctctcctccatttcattgtgttttgaacaaactcttctcaacaaagtcagtcttgacttatagaagaattcttatatcagccactaagaagatactttttccatctcagtatccctattattaaattaaagttaataaagggttaatttttattaattcaagaccatctaacacttaaaccaatggcatggcaactgagccatatcactggaagcctcaatgaggcatcttcaccatccatatctttggatttgggaatataagagatagaggatcctcaacttcaaacattccttttaacaagatcaaatagtgaaattggagagattttatagttttgcttagggtacattgataggaaatgattgatgtggaattcaaaatgaggtatcctaattcttagatgtctaaagacctcagattaacccagattaataaccacagctaatatttttcagtggttactccatgccagtaacttagccttcataatctccttttgtccatgtaatcacccaatgaagttactattatcctccatcttactcagtgggaaaactgagtcttagcaaagccaaggacctggctaaagccagatgattggtagaggaggagctggggtccagagagactgatgtcaaggctcagctggctgactgctgtgccatgttgtgtctgttatgctgttccttctctgtctgagaatatgtcaaagacctttatgcccaattctagccatcctcttattgtcctcatcccagagcactttctgaagcttcttattgcacagggcagctgccctgaagtggctccagcctgaagaacttcccctcaccctacagcagttctgaaaaatgcaacccactgtcgtcacagatcacccaccctggactgatttgtttttcaacagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 1509 - DNA, 196840 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatacgtgagtgctcccggcgcgggctgggggacccggggaccagacagacgcgggccggccccgcagcccggaccctgtggccggtccagccccggggtcccgggaggtctccgatgtctgggactcggaccgcccccggggacgagcgggatgctggggaggggcctcggagttgacaccctggggcttccgacggggtctaggtgggcacagcgcggggccccagccccgggcggccacctgctccctggccgcggccgcctggcgcccccttcccgcccgcagcgccctgggggtccctcggagaggctggctggggttcgagctgtcccggcggaccgggcgcccggagggagccaacttcgaccccgccggggcccgggtctggggaggaaccttcagatgcggcttccgcgcagccgtgtctgtaagattaagggattgggaggaagcgttacacttctgcagaaaaaggtagcaattgtgtttgttctttaacacccctgggggattcagaagcggagtttggaatctttttattttttaccttaaagtaaccaattagatcagaagtccggggtcttcttgggttcctctggaatttgccccttcagtgataagcaagtgaagagctcaggagggaagactcggaaggggaaaagttgattttgttttacaccagaggaggggaaaccggaatccctggcgttaggtgtaaaaaggggtgtgtggccgggcgcggtggctcacgcctgtaatcccagcacttttggaggccgaggcgggcggatcacgaggtcaggagtttgagaccagccggaccgacatggtgaaaccccgtctctgctaaaaaatacgaaaattagccgggcgtggtggtaggcgcctgggatcccagctactcaggaggctgaggcaggagaatcgcttgaacccgggaggcggtggttgcaatgagccgagatcgagccactgcactccaacctgggtgacagagcgagactctgtatcaaaaaaaaaaaaaaaaaagggtgtgtgtgtgtgtgtgtgtgtgtaggagaggaagaaaactgtcccaagcacagcgtttcctgccactgtcttgcacaagaggcttcattgttccatagaggctggcggtcactggtcaatcacaggttcgagaagtcgcatgcaccgggtttgatactagagagggcagtattatgggaactttgttctttcccggcataggaattacctcaggcagcctttcatatttatgagccttctttaaataggagaccttggccaaagatagataggtttcttttcagtgggggatgccagatcaatgctttcccccggatttatttattaaccaaaaacctcggagagtcaaggagacttgagtgcaccttacatcgtttcctgatctcggggaagccttaggaaggtcagcctgacttacttaagtggagagaactcacccctggtgattctgatgattccgatgctagatcttgaaaggcttggctccaggagccttgtgttactccctcactggtgctcgagcccccagttcaaatcctaatgtgagtggtaaacctgtgtttcactgtggtaacgttatagaagacccaatcacagtgactataggtaacctgcagtgtaagagaaatgctttattgggcggaagcttctgttctcagttgtgtcgctcagaagtgtgggtccctagacaccttattttcctgctttgtttccttcgagcgaaatggaagagggaagggactaacactcactttgcccgcggtgttcccagttcattccgttcccttctaacactcagtgttaaaaaggagggtcacgttgtggggctaatgtgcagcctctttccatagaaatgagagatggatgggccagcccggctcaccctttggagaatccccccttcccagccggtttctgaccccttcatcttgggagggggacagacagacgtccaattttgatgcttgactccctttctccaggccttcagctgttttctgttatatagatctatataagtgtttgcgtagcttgcatttttaattcccctttgctgtattattacgcttatggcatcacattttcttttaatctaagcggtaaatattctttagtgaacttttccagcatatacattattggataacgtctcgggaatacgagttgtgggataatattatttctgtttttctcattccacctgtgttttttgcagtgtattcatctggctacctcacccatatttacacacagagccattcatctctatcattttaagttcatgtctatggtattaaactaatttgactttttccagaaacagtcatgatctgttttcttgtaattgcgttatcgtccactatgtaggactaaattatatttccttttgctacagaaaaaagagtctgggattgaatactcatatttcctcatggtttccttatgtgacttactttattaaaaaggatagataaatagaccctgttccttcttggtgttcacatagtcagaattcctgggacaaagaaagctttccagctccttctgatgtgtgagggtggctaaaagataaagaagtccttggaaaacattgctgtaggcattttattgtggattaaccctggagagatagcagaggcaaatgagtgagagaacagatgaaggttaggccagggtagccaggtactccacactgtgtgttactggtggtttgggtgtttggatggaccggagccatgcagagatactttgtatttgtaaatggtgccgtgtttgtataccatgaggagtgcttgtgcttatggggtagtgtatgctccctggggtgatgtatgtgctctggggggcgtggggaaaagcgtgtgtgccgtggggtagtgtatgtgctgtggggtagtgtatgctccctagggtgatgtatgtgctgtcgggggcgtgaggtggtgtatgctctctggggtgatgtatgagctgtgggtacggggagaggggacggggtggagagtgtgtgtgccgtggggtggtgtatgtgctgtgggagccatggggtagcgtgtgtgccgtggactggcgtatgtgttgtggagtagtgtatgtgctatggggtagcatatgagccatggggtagtgcatgtgccatgaggtagtttgacctccatgacgtaacactttaaaagcacttctaggccaggcgcggtggctcatgcctgtaatcccagcactttgggaggccgaggtgggtggatcgcctgacatcaggagttcaagaccaacctggccaacatggtgaaaccctgtctctactaaaaatacaaaaattagccgggcatggtggcgggtgcctgtaatcccagctactcagaaggctgaggcaggagaattgcttgagcacagaaggcggaggttgcagtgagctgagatcgcaccattgcactccagcctgggcaacaagagcgaaactcgtctcaaaataaataagagtatttttaacagcatggatggagagcgagttccatttcctcttcagagctgtaaggtgagcaacaccgattcaggtagtttaagttccgagaggaaccagggcagcctcagcgggtagcttagatacttttcttagatactctctgggcagtggcctgaatgctgagtgggagcctccctgcccttcttagccatgtggccttgggcaagtggcttaattccttctgcctcagttttctcctctgagggtaagagcagtactcatttcatagctattgtgagggttgaatgaggtaatctgggtggagagccaagaatggggaagctctcagtccgtttgtcatgcctggctgttaacatagctgagtccctgggtagggttggctggggagagagcaaacctatgggctgccagtgctgctgctcagctacctgtgggtcccggcctgctggcgtcgtgggtcacaggagaggtaaaccgggcaccctgacactgagcatggtgtggagctcaggtaggattcagaaagctttacacgctgtggtaaaacagcccttgatctctgtaaggctgagcatcccggcgtgggcaggatgcttccctccctcttcccttccatgcctctatgtagggcatttgatttttcttcagagttctgtgggtcaagaactcagtcttgttatggtcctataatcttctttcaatgattcagcccagatattccttgttagttttgttcttttgcctgtcagagcttctgcttgtttctaccttaccattcttgcttcttaacattctaagatagaaaacattgaaggatctgaaggatttccttgctgacagtagataattactttcaacacaaactgttataagtttttttctaagagaaaaataaacatttttgcttcccgagaacttgaagcagtgctatattagagtgtgttaaaccttctagaaagtccagctatttatatgcatgcatacatatctgcttcttttatttattaccgaatggtgtataatgtgaacatcagtgttcaactgtgaggttgccccttctgaaagacagacttatttatttaactcagttatgccagcccctgttttaaaattttagaaatgccacataattttggagtttcttttcctaatccaggattagacgatccagtgggaccttgctgttgttcagctgctggagtctacaccacaggagcactaagttaagctgctttagctgccaaggtcttcaggtatttgaaataagtgaatcctgaggcatagaatccaagactaataatctgtctccagcagtgtggtggcaagcctgcagtacagactcgtaaagtgttcataatgaacaaatgtttaaccaggcagctcatcacacgaattcaccaagcacccttcttgtcttcagggcctcgtgtcttccacctggacattctaaagcagtctgcccagatgcataatttcacctttgtgtctacacaaaggttgaatcatttccattgctttttggaaccctgttgaatatctgcttattaggaacaagcatcttgaggtgcttttatttcttgccagggagtgaatttaataacctagagggaaaaaagtttgtattattaggtttggctatagtcagctaaatttctagggataagaacactgtcttcagtttacaattagttaaaactgtgttgaatccatgaataaaaatacatagttgcttaactacacatgaaatcctctatttacagatgtattaaaccctaaaacccaaaatacaaattgttctctggtgcttggagcatatgttcaatagaaacagggttaataaaagattctcaagtcccagacttatcaatgtttttttaaccaagttaaatgctggtaaaaatgctatttatttgcaataaaaatcaatagcaagcaagttttacagagtagaaattcaagaagatcagataagggatgattttctctttcacttggatattattatctgagaagaacaaaatggtacatcccagaggtgccgaggttaggcgtcggagtctgacagacccacattcaagttccgtctcggctgacggctgcgtggccttggcaagttggttgccccctgtacgcttggtgccccatctgcaaggtggggactatgatggtgcccacctggtgggtctgtgcagtgacgggacaggtcacggcgctcgtgcacgctgggtgcccagtgcacggggcgtctttgttgcgcgcatggacctgcggctgcatcaccgtccatgcttctgggcttcttaaggagaccgcctctcaccttgggctttccggaaccttctccccgcactcctcttcacgtggagagtgggtgaccttgccctgctctcccggggagagcggtggtcactggtgggaacgcccctgccacgcccagcagcctttctgcctctgcgcttgcctcctccggttggagcgagtgacccgttctgccgaagtccagtcccgtgtgtgctgcggccccgtctctctccctctctgagtgacactgtctgccctgctgcttgccgtcccgctgttggcaccgctttagaccccatatttcccagcggtcaccgtgctcatttttggcttccagctaccgtttttcttaggttaccccgcgtagctggcccgtccttccttctcctgtctcttctgtgcctaccgcggggggttcccttaccaaggtctccatcacccccaggcccacctccctcgggcccctctctgcccttgccctccacctcagcgactccgtggggcttttgtgatcccagctgcagttagcgagcgcccctgtgtgctcagagacacgccagtgagccgggaaggacagagacccaagtcccatccctctggggcccccttggaatgggggaggcgaacaggaaaccaccacagtgagtgttggggtgccccgcaggcgacggtgctgagaaaaagagagtggggttgggggcagtgcgtgcgcaggctggcgggtgggcgaggcgggtggaggatgcgtggggcgcagtgcttgcgcgcagtgggtggcggggtggacgaggtgagggcctggccaggtgggtgcctgcgtgtccagcctgaggggcggcccacgcagcagcctctgggagccctggggccttccgtgggctgcttcctgtggcgtcctgcgggctggccgcccctcggtgggctccggtgctggcctctgccttccccagggccacggtgggctcctagtggcctttcttccctctccatcaacatccttgtcccaggaagaggcgtccactgcctgctacacgccacccagccgtgttcatttccgtgttccagtgtcacccgtgtgcctagaacgttcctggcacagaaaagccacgcagaaaacagctgctgggccaacaccgagaccccaggtcattagtgttaatcagagtgatgaagaggttgccattggcaattcggaagggaattcagggagagcagccgcagtgccctgtccccagagcctggtgtccagagccagagttccgagggcctcctcatagttttaaaactctttattttatttttattttttatttttgagacagagtctcactgtgttgctcaggctggagtgcagtggcttgatcttggctcactgcatcctctgcctcctaggtgcaagcagttctcttgcctcagactcctgagtagctgggatttgtgccacgacgcccggccagttttttttttttttttttttttttttagtagagatggggtttcaccatattggccaggctggtctcgaactcctgacctcagatgatccgcccacctctgcttcccaaagtgctgggattgcaggtatgtgccaccacgcccagccctgaaactactttcattttaaaacgatgagttcctaagaactagactctgatccctggaaacaacatgccaacctctggcatgcaggacctttgctttccaggcaggcatttcccaattttgttagattctcaagggagcccctgcccctgctaaagttaagactcctgtgctgggacaggcaggctcctctgatgtggctgcacgggcgcactcagcagcctcgatacaatttgaacttcttgctgacatttgaacacagaggacggcacatacatccccacatttccccacttttttggaagtctcgtgactcctggcctgctggtttcccgaggaccgcttctgctggagcgatggccacttggggagggtcggtgctctccactggcctgagttgctgggcccatcactgctgcgtcgaagcctgagaccaccccacccggtcccaaggaggacacaggcttttctggtttggttgagacttgcagagcctaaagaaaactgctgagttgtttttgcgagttacctaatggtgctttagctgctgcatgcttttgtcccatggtgcgtttgtttgtaattcaccacagctgtaattgcagcagagccagagagctttctccttattacatatcctgagaaggaagccctggcagcccgacctgagagagggtgatgtggctcactcatgcagggatgctgggacatcaggctgggagtcaagagatggaattttaggctttctctgccaccttttacctttgtaactagggttgatgtgtgaaccctttgggcagattaatcattagttgcctctttaaaccaatcttttatttatttatctttatttatttatttttgagacaaggtctcactctgtcacccaggctggagtgggtgcagtggcgctatttcggctcagtgcaacctctacctcttgggttcaagtgattctcatgcctcagcctcccaggtagcttggattacaggcgcctgccaccacgcctgtctcattttttaatttgtatttttagtagagacagggttttgctatgttggcaaggctggtctcgaactcctgacctcaaatgatccatctgcctcggcctcccaaagtactggcattacaggtgtcagccaccgcgcctggtctttaaaccaatcctttaaatcttctccattttcaaagtagagtgggaagaaactgatttttctatgaataaagattgtgtaagtcgttctttcaaatgtgatttgtgttcacattcagaaatttgttagtgacatattttcacttatttgcaagtgcctttccttacagtttttctgccactcaactcagatgagttattctcaaggataaagaccacttagatgaatatattttcaaattcttactctgaatgtgtttaagtaaccaccctctaccccgtttggcaaaatgtttcccatttttctgtggtttttattttattttttgtggctttcagaaccagatcacttcttggaaggcatattagaagtttgcagttgagacgataaaataagtcactttttcctgggaggtggtattatgtcacacatcatttggtatcaaaatttcccccggctgtggctgcagagttgaaggacatcagctggctgcgcttggggttggtggtccgttgtgaactctgcaccgtatagtgtgtgtgctttatgtgcaaacgttttaacaaagacaggttgctgcgggcaagaagggttttaacttctgttcgtgttacttctgctgagttggaaggagcacatttcacagatgatgtcattggtggaggccgagcctgccagcaccttgtctgcgtgtgctttggctggacgatggtctacactgggcccctgtgcagcctcctgccggggagcctgtgtcccacctggctctgctctgagccattcatgtcgcctccagtggcagctgtaaaatgaaactcatggcctttgctgtctctcttgtcctgggtggtgaggatcaaatgaacctttattaatggacatgaaaataaccttgtaatttcatacactgaaattacacttttcgtacgcttttcaatgtaacacattgtaaagcgctgtaaaaatatctcaggaaagggctgccaatttttgtcacatctcatgtgacaaaggtaattttttttttttttttggcttggaaagggaacgaaaataagatcatttttcctggtaggaaggtaaaagattttaaagagaaggtttgttacatgtgaaaaaaacgatttgatcaaaggcataattggttgaattatgcattcgacaaggatggaaattacacgttcaacaaagatgtgaagagcgtgcagcctggcaaggcatctctgtccttagcgtgcccacccccaatacgggaagggcaggagaggctggcatgaggcacccgtggtccgtgctgtgggcacctccgggaggcagcctgggacaggcgggtcctgctccagagagagaaggggctgccgtccggcatgtctgggaggctgggtccttccttccccaagggttgtatccacagcccctctcgatcctcacagcagccctgtgaaggagcactgtgccatcctgtgacagggcagccaggtctcattggcactgggtgctgagggtggtgggtgggcgcaggccttgatgcctgactctgaccttgttctccccggcgtggtctgcaccctgtgaagggtgagtgaacgccctcctggcccagttcagccccaggttgtgcctgttgtccccacatcgttaataattatccatagcgtccccttcactcgcagaagcgtccgagcttagacagcaggttccacggccactccaacatgcggtctcaaacccagggcctgcaactcccgccatgtgccccgttctgcttgtcacccgcctcgccctgaggagcctccagctgcttcaggacttgtccctgtgtcacacatccagggcagttgttcactagcatccccgctacccctgaatccatctccacgtgcgtgggcttggacctgcttctctcgcccacttatctgtgtatctctgagtagtgagacttccacgttagcgctgtggggaagaggctgggcttggctcagctgctgagggatcagccgaccccaggtcgctgcggccctttcaggaggacgttggggggcaggagtggccggcggccacctgagaatgggagtggcacccgaatatgtggaatacacagaaattcgagtccgcctgtggccgtctccacggtcctttctaccatgatttctccatgtcccctgcaacagcgacccatcccagccaggagaggagaactctgggaggttgcctggcagttacaagtgtgttaagtattgttgctgcgtgcttatcagttaggctcaggcacagctactaacttccaggcatctcggcagtgtctggcgtttggcagtcaagttgtgtttagttttgacttaaagattaaaaggttatagaatacaggaataatctaccttttgaaggaaaacttgccaagttcgcctgacctttgaaatgccaagaatcccagagatgttgaaggaagtgcccagaggaagatctggtccacagtgggtattcagcacactgatttctttcctataaaaaattatctgtcagggccgggcgcggtggctcatgcctgtaatcgcagcactttgggaggccgaggcgggcggatcacgaggtcgggagatcgagaccatcctggctaacacgatgaaaccccgtctttcctaaaaatacaaaaaaattagctgggcgtggtggcgggcgcctgtagtcccagctactcgggaggctgaggcaggagaatggcgtgaactggggaggcggagcttgcagtgagaggagatcgcgccactgcactccagcctgggcgacagagcaggctgtcaacacatttataaccccagcaatggactgaggtgtgagtaggttccgcgtcgcccttttcctcccagtgttacccccggcactgtgcttgtgtctcggcatcctgtggatggggcctgcggttatccagctggtggttcatgagcacacacatgcctgaggagatggatggagacaggcgttgctagtagcagttcctcctcttgtcacagagtgtgcaaaaacactcttaagtacagcctggtgcgatgggtcaagcctgtaatcccagcactttgggaggccgaggcgggtggatcacctgaggtcaggagttcgagatcagcctggccaatgtggagaaatcctgtctctactacaaatacaaaaattagctgggcatcgtggcgggcacctgtaatcccacctactcgggaggctgaggcaggagaagcgcttgaacccaggaggcagaggttgcagtgagccgagatcgcacctttgctctccagcctgggcaacacagtgagattctgtctcaaaaaaaaaaaaaaaaagaaaccactgtaagtacagacaccgtagcaaccacacggaggccccccgccccgccccccgcgtgttccagtgggaagcagagcctcggaaggcgtgcacacggggggtgcgtgatggtgtctccctctgccctcagatggccaggcctcgggcccgatgtgccagggtgggttcttgtgttccgcgggcttcttgtcccttctgtctgctgtgttgtgcgtgcgtctctctgggtggccttggccgggcttctctctctgtgagacaggcgcatctctcagggctttcttcgttctgctgatatctatcccctctcaggaccactcggtttcaaaagcggtaactaaacttgtctaacacgtgtgcatgagaggaaggcggccagaggcatgggtctgagggctttgcttgaagagcgggcggtgtgcgtgtctcgcagcgcccccacctcggtgtctcagggccttgctgtcttccgcctttttcccagcgtctcaccagcaaagtgagtttatgagaatcatgttaacacacaggcttgatgattgagaaagcagatgctgagaatgtgactatggaatgaataattttcattatgaaaaactgatacattgtttacgacatgattctctgagatgcttgttgctgagattacaaacttaaatggttttattgttatgtaagcacctagcatcttagtgtggagctgaacaggtactgcctgtgtttcagagagctcagccgctgttacagaatactgcaggctgcatggtttacgcaatagaaatttatttcttgtagctcttgaggctggaaatcagatcagggtgtctgcatggtgaggtctggtgaggggccctcctggggggcaggaggctgtgtcctcccagaggcggggagagaactctctctcttcctcctcgtaaccacacaccaatcctgtctgattaggacacagacctcatgatctcatctaatcgtaagtacctcgtaaaggcccaatcttcaggtccaatcacattaggggttagggcttcaatatgagatttttgaggggatcacagttcagcccacagcagtgtcctggtgaccgaggcactatttagatggcgaatattcagacggatcggaaatggcaaagaggacagtcagaaaaacacattacgccttgtctgttgctttatgaaatagatgacagaagcatgttccacgaagtctggaaagacagaacgtaattacttagtgagaatgggttattttttaagttgtggaacaaagttaggtaatttgacccttcttagatgtaacagaccgcagttcccgtggttggttcggatctaaggttctgtgtatttatgtcttctttttgcttttttttttcccactggagaaagctggtaggggagaggtggttggtattaaaacaatgctataacatattgttttggtgtttgcattacaatccaaacacacagcatctggcttattgacaagacagatgttagggtttacatcacaaaacgggattgggcctgtctgctcagtaaactcagaggctgctggatcatgatctggttcttccagtaaatggaattgctttttggagcccatactctgttcacctgcgtgtgtggaggaggacgtcttaccgttgacaaaattggaccgtgctagttggaagttgcacttgaaatgcaggtcagaacaatgggatacgctggtcctgctgtcccaggcgggggagtcacgggagggctcgagtgccacaccacccacacgtcagccaccatgtgggttcccaaggcaagcagtgagttcccaagccagctgtcgtccacctttctgggttagtgtctttttaaataatcaaaggtctttaccatccattaagtactggcccagttgttgtacgcacaactcagaggtgattgtaggttgtgactgctctcagtcggtagttagggtggcctctggcgattgttggaggaattatgggtactttgcgctctctttcactgaaaatgcaaggccaagtggctccagcactcagcagaaaccataactggttttgatgctcttgggagcccaaggccacagtggctgctctgcccccgcgttgtcttatctggaaaggtctgtgggaggcgaggctctgactgcggcgtgcgtctcaggtttgtatctggagcacgtgagagtatgagatgggctgggggtgtccccctccctctgtacttgctcaagtacaggagcagcttgcctgagtctgagatgggctgggggtgtcccccactctctgtacctgctcagggacaggagcagctcacccatttccttcattctttctggctttgttgctcaccattgcctgggaaggaagtggctgcctaaataattaaataatctcctgcttcagagaaaagaggatttcctccaacctattttcagcaaaggattagggacaatgaggtcctgccagtagaatgccatctagattttggtgtggttttccaaggtctcagattgcccacgaagacatggaaatggctttcagacctcagcgggacccctggtgtgggggatgggaggtttgcaggcaaatgggaccacagattctccttcactttccgataaaatgcctcacaaacgtggaataacgggcatctccttttctctctagaaagtgcagtgaggtgacgtgatttcactcagataaatggagacaaaccattaaaatattaggtaaccatcaagtatacacgtgcttttttgttttcagtaataaatgactttggtataaatctgaaagcaacatgtaaaaagaaagctggagcgactgtcatggtggctggagtttccttttgtcctcatttctgatgttatttaactccttttaccatttctcggatgtaatgtggaaacaaaatgtgcaggccctcggcagcgaatgacacgtagagagggaaaccctgggattctcgtaggggagggtgtgtgatgtcctcagcacgcgggggtgctcagcagttgatgttcatcccgcacgcactgagcagctgctgtatgcgctgaagattctgtggggagcaagaggtacaggcgccccagctctcctggagactgggcaaggatggaaggcacatggcatgtagcacacccgctgtgaggaggcgccagggacaaaatgagaagggaagggtgtccgggacggggcatggaggacgggaagccggcagggaccatcagaggacagctccaggcagaggaagccccccaggagggatgagcagaggcctagtctgagacctaagcaggtgtcgactgcccctttagttttcttgctcacaatacagaatgtatgtgttgcttttcaatagtgttttaagcttgtttaatattatacggccaaaggaggaaaatgttacatagtaggtaaatttggatgatttttaacattataaagatgtattgctttattgaacgaatatacaatacattgatttataggtaatttttttattgtggcaaaacatacataaactttaccatcttgtccattgtgaagcgtacagttccatggcgttaaatacactcagtgctgtacgatcatcaccgccaggtacttccagatctttttcatcatcccaaactgaaactgattaggggcaattttaagtagtttctgcatctactattgtgtagcttgctttttgggcaacactcttttttttcatcagtgaaagagatcttaacgggtgaagagaagacattgaaacacaagtgctagttacgtttaaatgcaggatggaccgagataggaggatttttttcttttaaataattggccatagtaaaaggtaaaaaggtaaaaacttgaatgtgaggactcatttgcacttcatattttgcttaatatgctgagagctgcaagagaggaggatctggtgtttcatcttagagcaaatcatacttgatagtaagagacagaaagtcataaaagcgtgatgttcagcaggcaggacatttaaatcatacagctcataatgatgttagttgatggtgttacatggttccatggctttttcctaagtgtgtttataagaaattggaacgaggatgttttctgtggcattttcttccaggagctcggttctgctaattgcttggtttgaataagtgctctctttccagttggtctataacatttcttttactatctaagaaattatgaagaaatagattgattaatttgaaaattacatttaagagtattttcctgtaaaattgttggttctgtgaaaaacaattcctgttatttcttctctaaatacaatgagaattttttttgttcttatattgaaatagctctttgatttcctaaattgctgtgctgctttttaaaggacggcatggtttcagaagctattaggttggtgcaaatgtatttgcggtttttgcattgttgaaatttgctgtttgatattggaatacactcttaaatcaatgtggttatgccacacatcattttaatgtgaatttctcactttatgcttttttgcgactgagttattacttgccgtttaagtttattttagactgtggaaaagacgttagacaaaaagcaaattcgagcgattttcttattcgagttaagaatgggttgtaaagcagtggagacaactcggcaacatcagcaccacattgggcccaggagccgctgggaaccactaaacgagcatacagtgcagtgctgggtcaagaagttttacaggctgggcgtggtggctcacacctgtaatcccagcactttgggaggccgaggcagatggatcacctgaggtcaggcgtttgagaccagcctggccaacatggtgaaaccttgtctctaccaaaaatacataattagccctgtgtggtggcacacgcctgtaatcccacctactcaggaggctgaggcaggagacttgcttgaacccaggagacagaggttgcagtgagctaagatcacaccattgcactccagcctgggcaataagagtgaaattctgtctcaaaaaaaaaaaaaaaaaaagaagaagaagttttgcagaggagacgagggccttgaaggtgaggagcgtagtggccagcctttggaagttgacaacgaccaactgagagcagtcattgaagccgatcctcttaaaactacacgagaagctgctgaagaactcaatgtagccattccacagtcgaccggcatttgacgcaaattaaaaaggtgaaaaagctcggtaagtgggtgcctcatgagctgagcgagaatcaaaaaaattgtgattttgaagtgtcatcttctcttattctacacaacaaaaacaaaccatttctcgatcagattgtaacgtgcgccgaaaagtggatcttatatgacaaccagtgacaaccggctcagtggttggaccgagaagctccaaagcacttcccaaagccaaacttgcaccaaaaaaaggtcctggtcactgtctggtggcctgtgccggtctgatccaccacaactttctgaatctccacaaaaccattacatcttgagaagtatgctcagcaaatccatgagacgctttgaaaactacaacgcctgcagccggcattggtcaacaggaagggcccaattcttctccatgacaaagcccaaccgcacgtcacgcaaccaacacttcaaaagtggaaaaattgggctgcgaagttttgcctcatccgccatattcacctgacctctcaccaaccagctaccacttcaagcatctcgacaacttttacagggaaaacgcttccacaaccagcaggatgcagaaaatgctttccaagagtttgtcgaatcccaaagcctgatttttatgctacaggaataaacaaacttatttctcgttggcaaaaatgtgttgattgtaatggttactattttggttaataaagatgtgtttgagcctagttataatgatttaaaattcacggtccgaaaccgtaattacctttgtaccaacctaagtccccttattattagtaagaaacttaattgtaaaatggagtaattatatattttacatcgttagactcatttaaaaaccgcaagtatagcatgaaattgactagaaaccctatttgtcaggtaatcttcgcagttgacagaaaagtaaaacgtaaaaggagtattaatggcttttccttagcaccctcactcacaattttagttcattaaaaaatgggttgatattgatttctatcaacatgtcacccttgcaaacctcagagcgactgagtctgatggacagtttctcggcttccctggctgtcactcagatgtggcctctcactgtgggccccacgtgggctgcgtgtggccctgtgagttggtcccacccctgcccgacaagcctgtagctttggtcgtcttccaacgagtggctctcccgcctgtgttttgaactcatggagggggagggggagtttgtgcagagaatctaggatcatgtgcatctgattttatgtttttaatgggcctggccaaggaagagagagtgatttggttcctgtcttaacttgaagaccctctggggcaggcacatgttccagggtagactccgggagggatgggtgtgatgtgtctgtagggttccaggcgggaaggggagtgccggaagcaggtctgggagggggaattgggtgtccccagccagcctgtctcaggggcccatgtgggactcttggccagccctctgtgcccctcctggctgtgtcttcaggactaagctctgatttttttttaaatttacccaaattcctttctaaggggtctggggagtcatgccctacaaatcataaattctcatcagatgggttttatttaaccctgtatatcatgacttactttccaatctgactctggcataacaaggaagaaaatcaaaatgttttaccccaaaatatatttccttgtcataccttgaaattgccctgcaaggtcacttgtgggaaaaatccacattctgtagagaatcctcttccccctttgttttccttctttcctttccaggtccaggcaataatcaactaagatccaggcacccttttaagtctgataaaaagcaatttacaacctgccttctctgaagtccgctatctaagagcttcctctgcacaataaaacttggtctccacaatcctttatcttaacctgaacatttcctttctgtcatcccaggtcttcagataaactcaaccaattgtcaaccagaagatgtttaaatttacctatagcctggaagcccctcgctttgagttgtctcgcctttctgaaccaaaccaatgtatttcttaaatgtatttaagtctcatgcctccctaaaatgtataaaaccaagctgcgcccgaccaccttggacacatgttctcaggacatcctgagggttgtgccactcatatttggctcagaataaatctcttcagatattttacagagtttgactcttgttgtcaactgtctgcaaataggagctgcgcccatgagggcatagcccagttaggccgcgctgctccctgctgctgaccagcccctgttggagctgatgctgcccacatcccacagctgagagcaagggtctcaacagcacaggtcctctgcctgcactctgccctggagctgggcatcagccatggtgagggcctggaactgcgtgacacccgggtgtcaggcggccactctcagcatccacattccctcagcatcacggggaggccggctgcagtcgggaatcacgagtgtcatccatgtggtcctccctctttgcagacgtgtgtgtggccgtggtgtttaagttgtgtctgctgccttgggggccctttggaaaggctctttctcacaaagaatgcatcgtgttcgcaaagccagctcatgcctcctaatgtaaactcaaaacccaattcacccctaagcaagtggcccacaccgtgtgtgactggaaaaatcagtgtttcccgacaggatgtgacaaatggggctgtagcagggcagggccgctccccagaaaacaagcgccccaggttttcccttctcctgtaccactgccctggaagagttctacccatgagggcccttggagccatctcgactagaacgttaacaggaaggaaggagcctgcgggagaagacagggctccaggaggcggcggaggcctctgtggtggccaagcaggccccgcagggctgagctgctgggttttcctgggcctgggctgctctctggttccagggaggggttgtaacactcccggcagagctgtctcatggggagggcgttcacaggtggtgagtgtggacagtgaggggaagaccagttccagtctttggcaaatgctgatagtaatgaaaatcattttaaaaatcataacagggcagacaagtcacagctctggttggtcttcacctgccgtcactatcatccctgcagggagagaaggttcggctccctggggctctcccagccccgcgtcatgtgagggggcactagtcacagtgcgggaggcttcagagcggagggcagggcccctgccaaccacccggagccacccacccacccacccaccgctgtttgaagcagggactcggttctcaaagtgccggggtcagaggtcaccagaggctgctgaaatcagggttggagggctggcatgttcgtatttgggggaaggaggcaggatcccaggggacccgtcctgcgtgctgacactttaccacgaggcagctgggccgcgtgcggctcttccgacttttcatcatgcttcctgagccagagccatttaaaaaaaaatgctgaaatttagaaggtagtattcgctctaaaattttgtcgcttaaaaaagtggcttgaagtattcagcaggaaaattgtcccaaattacttgttaaaactaaaagctgggccaggtgtggtgatgcacacctgtggtcccatctacttgagaggccgaggtgggaggatcagatcccctgagcccaggagttcgaagccaacctgggcaacatagcaagaccctgtctctgatacatacgtaaataaaataaaagttaaaactcaaaggggaggaacctgagatccaattttaaatccacctgatgagaaaaaaaaaaaagcagcccagggacgtcaccgtaaacaggcaccgcatccaccaggggtcaggagtcaggtcagggctctggactgggaggggcactgcagggacatcccgtcagcgggcaccgtgcgttgagccaggggtcagggctttggaccgggcaagactctgttttgcttccattttttaagcctctggaagtcctggctgttcagaattccaggcttgaattgctagtgttcccgggactgggaaacagcccggatgtgtggagtaagaggcagctcttggattgctgtgaacgtaggggagcaaggctccacgccctctcccagcctctctgccttctgaatacagcccaggagcctggatgactcactttctggagcacatagataaggagcgggtggaggggagaggccttagttaattaacattcctaggaatctgaggctccttctcccagccctgttgtctgggtagcaacgtgctgaacccagagtgagaacagctggctgcagtgtcaggggcaggaccttttgtcgatgagtttaaaaaacaaagcagaagctgccaggtgcctccttcgcatgttggctcccacgtgttttccccgttctccctccccaccctgagtgacacacgctatgctgcttgaaaatagcacagatgcattttgcttcacggtgaaatgtggccggtagttccccaggagtaaacaatgtggtggtgcccacgggggaagagcagcttaattatgcacccagccccgcatacaaaacgctccctccatggttagaatttgctggggctaagggagtcagggctggttttctccagcagccttggagctaggtggtgtcatttaaatggccctcaaagccctacctggatgtcttcattgtgccacaccagcctttatccaagctcactgggccccacagtgtggctgatagtgagggtctgggggtgggggatcgtgaggtgagggacagcaaccccgtcctgtccttgtctaggcctctgagacaggcccgaaggacaggcttttctctctactgtgggtgatggtcccggctggtcagctagcgtccacagcccctcgactccctgcgcagagcccctctcactggaccggcgtcagtgccccacagagactggaaacctgtttccaaggtgtggctctatggccggaccacagtcggtgaggtgagggccagttccagccagggtgccacctctgccttttcttatgtccactggaaaaaataaagagggtgtttgtcatcccctgtcttttgggactcggggttcagtgcaggccaggggaggttgtgtctctggtgtttgctgaacacaaagcgtatgaaagtggtaacacctcggaggtgagggctttctttttatagcagccatgctggaactcagtgtctgaggagacctagagtatttgtttgaatgtttgaaagagacgtatctggttaatgtgagcagaggcttggaaatttagagcacgctcgactgtatttcagtagacttatgacagcagctacacatccatccattttagcattctcagagtattctaaaacatggagggctgggcacggtggctcacacctggaatcccagcactttgggaggctgaggcaggcggatcacaaggtcaggagtttgagaccggcctggccaacatggtgaaaccccgtctctactaaaaatacaaaaatttgctgggcatggtggtgggcgcctgtaatcccagctactcaggaggctgagacaggagaattgcttgaacctgggaggcggaggttgcagtgagccaagatcatgccattgcactttagcctgggtgacagagcaagactccgtctctaaaaaaaataaataaaaacatggagttcacaaagtggcatgaataatcatgaaacgaagtgacttcaaagtgtaatggttctcatgcatgtaagaattcatgttattaaacaagtataaataaaaaaattgtgcactgcataagtgacagatagttttgtagtatttgttaaagtgccatcatagccgcctgtgaaagaggtctcagtaggtgtctgattcttgtttaatgccacagcttctgagactccatttgtttcaggcagagtggacatttcactcgcggtttaatttgcgggaagatcacattctggccgtttaatcttctgatgacagacagctaactgttgataaggataaaatgaaaccagacatcggtttgcatgtgtccagttgaggggaaaaaggccgaggatgctgtcaggacgcaggcaggcaacctatttaggatggggagtagcagttcagagggtgtagcttccattcctggccccagcctcccttccactcctcccacccctgatcccagcctcccttccattcttcccaccccagatcccacgcctcccttcccacccagcttccattcctggccccagtctcccttccactcccccccacccctgatcccacacctccctttcactcccccgacccctgatcccacgcctcccttccactcccccgacccctggtcccagcctcccttccactccccgcacccctgatcccacaactcccttccactcctcccacccggcttcctttcctggccccacgtctactggaattccactcctcccagctgtcttgcacccgctctctttccccttgttttctcttttccttcccaattagcaccgattttccttccccgattagcacctcccgctgccgctccagctgtgttctccatctcctggtctggggtgttccgctgcagccacaggaccccactgtgggaacccacgtctctgcagggaaatgtttacggtgactttcctatgtgtgtggctggctcgtcagggagcggtgtggaggagacctgaaggacagcccttccccttccctttctccctcctcactccccgaaccctgcccagctctgggcctccccagggctgaggagaggtggcgtctccactcctgacctggaggcccgtctggcttctggctccagccccctctgctgccttctttgtgtgtctgtgatggaatacgcgttctgcgtgatgagactgttatggagacgcaagagaatgtgaaggtgaagcttctcgaccttgggctggagcgggtggggtgctgagagcaccgagagccccttgccacctcggcttctggcaggtcagtgaggccactgtggatcaggcttttaagatcatgggaaaacacacataacaaacatgcaacatcttgtctagatttatgtgcacagttcagtgctttagcacgttcaccttgtgtcaccatcaccactgcccccccgcagaacttccgcttcttcccaaactgaaactccgtcccgcttaaattctctcctccttcccccttcccgtagaccctggcagccccattcaactttctgtctctaggtatttgtcagctcaaatgagtgactcacacaggatttgtccttttgtgaccagctcatttcactcagcacaaagtccacaagggtccctgtgttgtagcctgtatgactccgccgttcctttgcatggatataccacgttttgctcacacattcacctgttgaaggacacttgggttgtttcctgcggcagcttttcctgaccgaaagcttctcaaaaggactagccccctcaggtgccccaaactcgattgcagaagactgtgttgtcacctgcctgcttctacagagaggcaccaacctggggtgacatgtgcactcttggctttgtagtgtcctggcccatccccggtacctggccaatcccctacacctggcccacctccccacacctggccgatccccccacacctggcccacctccccacacctggcccacctccccacacctggcccacctccccacacctggcccatcccccacacctggcccatccccgtacctggcccatcccctgcacctggccgatccccacccttcacttggctgaggcccccccccacctgcctgatcctccccacctggctgatcctccctacctggctgatccccccacctggtcacactgcccctcctccccagagggttgcccctctgtatttacagttgattaaaatcttactttctctgggaattctttacagattaatcttcttccaaagacaaccctaacctgtgccttttcagcagttgtgctattttgcaggacgaattcgcacctgtttctgtgttgctctgtgatcattcccaagtggcttgggcttggagccctgttgctcacacctctgggggccggggaaggtgtttgccagagagacagagtgtatggccttgagggcaccttctccttagaaatccgatcccattcctttccccttctcccactaagggctctctgagggatggtagtggctgggtgtggaattgggttttgctttgctttctctccccagcagctctgggcaggctggctctgtgggggcctgggggtggctcctgcctggactttgagaattggagaggcttggagctcattctcagtggagttcccggtggctgctccgtcttctgagcctggtcctctggccttctgcagatgctgggagccacagcaccctgtgatagaccttttgccagagctcccatgagaagcatccaccgtggtggggccaagtccctaggccccaggcattccccatctggtgggaagtgggggctttagcaagtcgcatctctctctgcccctcctggtgagctctgctccgacagctgtgggaacccgtgggaatgcccacctaggtgcgtgtggcctggcgtctccccagattcacttcctagtttttcacttcacgtggcccagacactcagaaggaaccaccaacccagtggtctgtggtggctctgggggcctgtgggggccaccacctctagtctcctggtaggcatcccctccgcctctgggaggacgggagccgggacagagggggcaaggaggcctcctgggactggggcgttccccaccttccactgtgccggtcttcatgcagggccagagcctggctcggggctgggtttgcactgagccaggtcctgactctcacccatgtcttgggcacgtcgatggggccgggccgctggagagggtgtgagagcaggttcctccccaggtctcagccagtgacggggcccatcctggacttgggggctctgcgtgagtggggcagtggcagctcctgcagggcccaggtggggtgtgggtaggtcggggaggctgctggcctcccagcctccctcaatttctgcgttctaaagatggctatgtgcaaaataaaggtgaaatgatggggcagtactggatcaggtggacatccgggagctggaggcccgtgcactttccctgggacgggcagaggcttgtggtgtccacccacagacgcagacccactggcctgcagggcccatagaggctgttgttggccctggtgatgagtgggggacacgagtatgttctgaaatgagggggaggcttctgttgtgaccttgaccaggaagagaaagagaagccaggaggagagcagacacgcttccgccttgaggacggcacttgttcaagtgtaaagaacggaacaatcgggacaaaatttaaaatgcaaatatggtctcatttatttgtaataaaaggctgctggaaagtaggtgcaggagtggcccaggttagcataatactttttctcctaatcacatccaacttgtttttctactcttatttcagaacatgcccccccgccatcccaggagaagcagcagctctctgcctccttgactgagctccattacctccaagctgagagggttgttcaagagggcgtgtgggattcttttgaaaacacatttttagaaagcacccttttaacaactgaacatgatttggttgaaaataaacatccccgggtactcttgtggtacatgtttatgattttgatgcttctggtctgaatgtacaaccttcacattgtacattacaaacactactgtcaagtttatagattttcattttatttgctaattcatttttcagttctctgcactgcttgtaaatcaggcaaacctgataaactgtctaaacatatgatgatactgaattgattaagttatggtcgtaggtgagaaaacagtacatgttgtgtgatgccattccgaaaaagtttcaaacacacatctgtgcattagaaatgattgccacgtggccaggcacggcggctcacgcctgtaaccccagcactttgggagaccgaggtgggtggatcacctgaggtcaggagtttgagaccagcctgaccaacatggtgaaaccccatctctactaaaaatacaaaaattagctgagcgtggtggtgcatgcctgtaatcccagctactcgggagccgagtcaggagaatcacttgaacccaggaggcagaggttgcagtgagccaagattgcaccactgcactgcagcctgagtgacaagagggaaactccatctcaaaaaattaataaataaataaatgattgccaccgccccctgccccccaccccgccaaggcgtgaacaggagttgtctctccccctttgctgtgtgatagtctttttgcttgaatttattttgcttttccgtaaagaacactcattgcttttaccattggataaaaagcataaaaacaatatagatattaaaagcacctggatttttttgacgctttaacaattttaaatttcttttcaggtgacaatgttcaactctgctttttgtttgtgctcatgaaattttatttgttagccagccaaagccaagtgtttccagttaaatttacaactcttctgtctgttccaaacacagcctaagcaagaagacaactgtgccgcctgccgcaagtttcatgtgaaatacccccagagggcagccgcctccgctgggggtcctccctccgaggtgtgtgcggtggggatgggaacccgcagaggcagcacccagctacttgccacttaggttcttctaactgccctcgagagattgtcactgggtcctggatccctgggtttggattagcagtcggaccagggtgggcttgcaggctgcacttttttttttttttttgagactgagtttcattcttgtcacccaggctggagggcaatagcacgatcttggctcactgcaacctccgcctcccaggttcaagggattctcttgcctcagcttcctgagtagctgggattacagttgcacgccaacactcccagctaatttttttttcttttgtatttttagtagagatggggttttaccatgttggccaggctggtctcgaacgtctgacctccggctatccacccgccttgccctcccaaagtgccgggattacaggcgtgagccactgcacctggcctgcttttgaaataggacgtagggattgagggagggttaggatttcaacgatggctttaacagaagaagagaagatgctgaaagtccggcttatttgaactgtgtgtgtgtgactttgaattgcgtcaaatgccatcttggtgaacagttggaggggccctcaggatgccctgtgacgcgcaggtgtgactttgaatcgcgtcaaagaccgtcttggtgaatagtcaggggccctcaggatgccctgtgacgcgcaggcaggaaattatgatggtgtgtttcaggtatgcaaactgcaccagaggcaacacaaaagcaagtcaatataaaaagactcaatgccttgcatgcctttgttatattctcacgtaatcttcaatcttctgttcatgactttgttttgaaacacttttaaaatgtaagattaattaacttgtaggctgtgggaataatcccatttgccgaatcaaaataatgtatccttgattccaactgtcagaagacaaaattacaaaacatttagttatagatctgattggattttaattacaattccttaacggggcagcgtccgttctacataatgagagctcccactgggcaatggcagaacagtcagttttgtaaggtggaagcaaggaaacagaataagaagctgatggtgaacttcaggttacttcaggttacttcaggttacttctttgtagagggtaaagcagaggggactttgtcacttgctgactcaggtcaacagaatctcctatttttgagaaaaaccggtctgttttgggacctgtcacttctttaaagttccattttggtgacgtggcattgagcaggagcaactccattcctgtttggtctggtctgttggggcctagtgctggagctcagtccaaaacaacagtctcccataatttaaaaaaaagtatttccatttcatttctggaaattcagcctaagaaagtcatatcccaagtgcccacaatcatatcagaatgttctttgcagcagtatctgttgtagcaatgaaaacatctcaagtctgtggataagggattgatcaaatacattaatgaccattctgttaatggaaagaccaaagtctgtaaactattttaaagaggtttattctgagcctgtctaagtgactgtgggctggggaaacagagtctgagaaggtgcacctgaggcagtcagatcacagtttgggtttgtatattttagggagacaggactcacaggcaaagccacaaatcggtacatggaaggtatacattggtttagcccagaaaggtgggatttcttgaaacgggtgtcacaggccataggtggagtcggagattcttcagtgtgcgattggttaaagcagtaaagctttgttgaaagcctggagccagtggaagggagtgtttagatgaggaaacccacgcccgacgcgcagggtcagggttacctgtggggtgcgttcaccttcgtctgctgtggccgcgggtcccgtgagcctgggttgaggcaaagaggttgtggagaccggggctttatcacgcagatgaagcctctgggtagagtctgtttgttttttttttaatttttttgagacggagtctcgctctgtcgccaggctggagtacagtggcatgatctcagctcactgcaacctctgcctcctaggttcaagcgattctcctgcctcagcctcctgagtagctgggactacaggtgtgcaccaccacgcccggctaatttttgtattttttgtagagatggggtttcaccgtgttggccaggctggtctcgatctcttaaccttgtgatccacctgccttggcctctcaaagtgctgagattagtcttccgtgatgtctactttgacatcagtacctaaaatccaaatgggaggggccaggcgtgttcaacctcccttatgtcgtggccgagaattcagttttgaagttgcctctggggttcctttggccaagaggggtccattctgttagtgggggccgagctggaatttggctcttgaagtcagaaggtgaaccacaggccacagtccgcagcctccaggagctactgccgccagctgagggccacagttgctgatcgggaaagggtgtatgtaaggccagtcctctgtccggtcagaagtggaagggtctgggttgtaaatcagagttagggtccgattgctcctctcattagggagttggagtgtgtttttttcttgtagccttaggaatttaggaagttgctggaaccctctgccccgcaggtaacttttgtttccttagcgttagggtccatcttagtcaagaaaactgtttgttttggtctcttagatcacaaatgttacgggaaagaagcaggaaggaaggctgaaaagagaaaacgtacctttgctcactaagcactaagaacaaagaggctttgttctcttgcgtgtgcatttggatatgtcgagggaagccgggtactccaggcagggcccagaggtggtgtcaccctggcagcacactgcagcggtcactgctgaagacacagaaacagcttcccgtgttcttggacttgacatcaaagatggaacggggatgtggcctgggaacgaggaacgtggaagccaggagtgaggaagtgggagggtcccacaagacagcagaagggcctggggttagtcccggggtcagttgtgggacgctggtgctccctctcctccacggctgggcttcccggggtcatgaacctgtctcctgcccgcctcttctggcccccagcgaatgacattgcatataactgcttttttagagtgttaagaaaaaggctgtttcccaaattcagattagtatgagcaaaaagaaggagaccacataggagccaggatgtgagggcgaccaggaggttcaccaggccgtcagcaccgcagccgctggaggcgccaagtgcaggccgtggcagacaaggggaggccggcacactgcccaccatgggagctgctgggtcattttaacttaaatatcctggggccacataaccctgcaatctgaaggacgctacagtttgcaaaaaccaaactctgtatcagtgaagggtccaactcacaatatttgaggagatttattctgagccaaatatgagtgaccatggcctgtcacacagtcctcaggaggtcctaagaacaggtgccaaagtggtcggggcacagcttggttttatacattttagggagacatgagacatcaatcattgtacaatggttttgcccagaaatgcaggacagctgtaagtgggccggcggggggtagggggaccggggaggagggtgggcccggggagaggggggcggccaggggagagggtttccaggttataggtagatttaaattttttctaatggacagttggttgaaagacttatcagtagaaaggaatgtctgggttggggtaaagaggttgtggagacagggctttatcagggtagcgagtttcagggagaatgaatagattgtaaatgtttctcagtggacttcaggtctgtgccagcgtttgtgctggtcagcctttcctgaattccaaaaggaaggagggggtgaggaggcatccgagtcccatcagggccggaagcaggttttcaggataactttggagtgcccttggcggagaggagggctccattcagatgggtgagggcccttcaaatttacttttggtttacatacgtaaaatactttagaaagatttattctgagacaatatgagtggccgtggcttggaaaaacacaaacctgagaaccatcgaggaagtggtccaaggtggtggggctggttggatgttacacatttcagggaggcaggagtcataggaaagacgtaaatcaatgagtggaaggtcgacgtggctcagccggaaaggcaggatgacttgaagtaaagtaggcggattcagaaatgctttacttttttctttttaagtattttttttcagagattctttaatttgcagttgattaaaggagtaaggttctatctaaaacttggagtcaacagaaaggaatgtttaagataaggaggccctgtcagagtcagccacagggtcaaagagccctgtttagcaggtctgacgcccgcaggcgggacttaaccctcatctgtaatggcactgggccctgtttataatttggcatcttagtgccacagagtctggttttttttcttcgatcctgtgagcgtgggttgaggtaaagaggttgtggagaccagggctttatcacgcagatgatgtcttattggtgtcttattgccacagagttccccacctccccccgccctcttgtcattcaggctgttgtgcagtggcgcgatctcggctcactgcaccctccgcctgccgggttcaggctattctcctgcttcagcctcttgagtagctgggattacaggcacacaccaccacacctgactaacttttgtacttttagtagagacggggtttcacaatgtcggccaggctggtctcaaactcctaacctcaggtgatccgcctgccttgtcctccccaagtgctgggattacaggcgtgagccaccgtgcctggccagagtgtattctgtttgttttatgatctctgtattgatgttaatgctggtcagttgtgtctaaaccccaaaagggagggggtagaaggaggtatgtgtaacctctgtcatggctgggagctcagtttttaagatttttctggggttcccttgaccaagaagggatccattcagtcggaaggggcttaggattttatttttagtttgcaagttgaatgtctaggcagctgactgaaggttatttgatgaagccaaatgcctggatgctcccaaagtgtgcatatctggtcctctgtctcgcccgaaacccggaggccctcagggcctgtggattcccgggaacgctcgtgtcacacgggctcgggtggcatgtgcggggacataccacttaatgtacatacaagcctgtcgtgtggcgcagttgatctcaacttttaaataaagaagatgagcatcgccccctccatcatccctgcccacacctctcaccagcgcccactgcctgggtgtggaccagcccctatcgtccccatcgcccccttcgcccccttctcccccatcgcccccttcaccccctttgcccctattgcccccttctcccccatcgccctcttcgcccccatcggcaccatcgccccattccgacactgcatgccctgagttcaagtggaccccacaggttatgggctctgtcccccaagacggcctgcttcagacacagctacaagtctcagggaccacctacacttctgagcacctgccataaacgtcagggagggccctgtgactcagggttgacgatttactggaaggactcgcggaactcaggaggtcactgtgctgaagacaaggggcttatgatggtgggagcaatgtgatgggtccactgggagccccctgtccccgtggagctgtcacgtggccctcctccagaaccgtgtatgtgcggcagccaggattcgtgcatccagagtttcatcagagtctcatcactgcttgggggtctcatcacactattggccaagagattgagttcagtctccagtgtctcccttctccccacaggtcagaggtcaggctggggatggaagctgcagccctgtcctggggtgaggccggcccccccccaggaagctgtttggggcccatcttgagtctcctcattagcataaactcaggtgtggtccacaggggctcttggtgagcaacagaaacactcctgccatgtgggaaattccaagggtcctgaagcatgctgggcaccggaacagaggccaggtgtgttcctcattccaccacggagccagggtctgacccaagtgtttctgtttccaaaggtgatctgccttcctctgctccagccacccctgcggccatgcctgtggtcccctgtgtgggctgggctgtggccttggacctggtccccacgtcattttcttctcccttggggtggattgtctgtgggcccggtgtgggaccaacagctgatggccgacgcctcttgccgtaggttgccggccatgcatacctgggggaagacttgaactccatccctctgtcaaccctgttctgagtcacaagagacactgcaaaccccccttgtgggagctgactcaggctcgggctgggctcaaggcagtggggtggggacagacaggtaaacctgtgatcatgatacgatgtggacctcccatggccaaggtgaatcccaaatgctttgggagcagagtgaccaaaagaagacccctggggagcagacgaggtatgggcagaggcatcaccccctccactctctctgctctcagccctcaccagcccactgcccgggcatgcaccagcctccttcgcccccatcgcctggcccctgccacctgggtttctcagccgctgccttcactcacccctccccacaccagtctggagtgataggctgcgtctgcacgcggctggctctgcctaggtgcccaggagtgactggcacaagtgtgtgctctatgtgcttaatgcctctaacgaccaagtgtgggaagcttttctcgtgtgtagtaatgaaatagctcagatgtaagcagaacagatgcaccagccctcccatgccccagccagtgagtgtgtggctacagctgtggctgcaaagtccccatccctggagttccttggacaggagaagcttctatttgtggaggatgactaaggacaacgtccctgagggtggcctgttggttacaggaagctgaggtttggaacagatccctgcgtgcaggtgagaacgatagaaatgggtgaaggaggctgagagagactcaggagcccctccccggcagctgaggtgacgagggtgcccctgaaggacgccctcagagcaaggtgctggggagggggcgggaagcggtggccctggggcctgctcaccgcacctctgtgccaagcaagctttgtgcttttagttttcaccgactctgcttctgtaaacgcagctggtgtctagggagtcacaatcggtccttgaaaagaggaggcttctctgaagggaatagtgtgtgtcaccaggaggtgtatgccggggatggggcacggcgtgcgtgcagggagaggggccagggggcacagtgtgcatgcaaagagaaggcccagggggcactgcatgcgtgcagggagaggagccagggaggaagcacgtgcgtgcagggagaggggccagagggcacagtctgtgtgcagggagaggggctgggggcacagcgtgcatgcaaagagaaggcctggggggcactgcatgcgtgcagggagaggggctgtggggaaacacagtctgcatgcagggagaggggccatggggcaccatctgtgtgcagggagaatggccgggggcagttgataggtgctgggggacaggcctaaaggcagttgtacttccgagagcttttcccggcagattcccagatctgcaggtgaatgaggtgaaggagcccaaaggggccgtctggatggcagctcctgaccttctccatctgtgctgctgccatgtcctctctaatgctccagccgggggtgctgcagatgctgggggacagaaaacagagccaatcaaatgcctggctttgcaaactggaaaaaaaagtccattgcttttgcaatttgaagggctcacaggagcagaaaattagtggtgaagagtgttataaaattattggatacagtgccttaacctgtaaacttgaagctgaaagtgtgccatgagaaaggtacaagcagaataaaaaatgcaccacctaatgctactgtaggtcctctgaataaataattgtaaagacatcttccttgggacatggataatagggaaaaatctcacagaaaactggggacattgcaaattttttttctcatatacagctttacaattcttgcatagcttatgcgaatttcttactataacttggggttgtaggtaatagtaaatctgaacgctgctgctgctgcttctttttttttcttgagacagattgttgctctgtcgcccaggctggagtgcagcagcacaatctgggctcactgcaatctccgcctcccagggtcaagcgattcttctgcctcagtctcccaagtagctgggattacaggcatgtgccaccatgcctggctaattttgtatttttagtagagatggggtttcaccatgttggccaggctggtctcaaactcctgacctcaggtgatctgcccgccttggcctcccaaagtgctgggattagaggcgtgagccactgtgccctactgaacgctgtttctagtgataacttgctgctctatttttagcaagtttactatatttatttactttattcaaccagcaattactgagaatctgctataggcaggttctgggaacacaggaaacaaagcaaacaacagaaataagaattggtcttttcctggtaggaatttaaaatctaatgggagcagcagcagtctctttccaaaaaaaaaaaagataaatgccacaggtgactctagagaacactgcttttgttctttgcacgtgaaggaaccaggctgcctgaggtgtagaggctccacacaccatgcagggcccgcacaggccccatttggcaggcagaggtagtccctgcccgttttcttgagggctggtggctgcctgggaaattcacctgacaccagattgaaatgcagatcggctttcatctgtttctggagctaaactctggcttcgtgcagcctgccacgcagctcggggactccggcgctgggcgaggaactcggctccaggtgcatcttgttaaaggctgagccccatttctcacatgcgttgcggaatcgaattctccgtgtaactcagaactcagagtgaatgagagatcgatacatgtagggttccagcaagggccgtgtctggtgagcaggggaaaaacacccctttttcatagaccagggactggcaacctttttctgaaaagggcagatagtgaatgttgtaggcttatggggccttgaggtctgtgcacctgctcacatctgccattgtagcaggaaaaaggccacagagaaaatggaatgagtgagtgtggctggtgccagttagcttaatttacaaagccagtcactgacctttacccagataactggactggtggacccaacatggaggggccatgagaccatgcggcccacctccctgtgttacctgtatgtaccacgttgtcagtatccacgcgtggatgggccatgagactgcggcccgcctccctgtgttacctgtatgtaccacgttgtcagtgtccacgtgtggaggggccatgagactgtgcggcccggctccctgtgttacctgtatgtaccacgttgtcagtatccacacgtggaggggccgtgagaccgtgcagcccgcttccctgtgttacctgtatgtaccgcgttatcagtatccacgcgtggagggggccgtgagactgtgtggcccgcctccctgtgttacctgtatgtaccgcgttgtcactatccactcgtgggggggccgtgagaccgtgcggcccgcctccctgtgttacctgtatgtaccgctttgtcagtatccacgcgtggaggggccgtgagactgcggcccgcctccctgtgttacctgcatgtaccgccttattagtattcatggacctttaactacaaatattctgtgatcgcttacctctgctgttcctcttctccttgtctatcttgatatagttatggactgattggatttatggaatggatatacaaacagttcaaaattcaaagctaagagaagaatacacagtggctgctgacctctgctagcggcttccctcctgggggtggcccactgcaaactccaccgtggccctggtgcatgtgacaagcaaatgcagtgatcagaggcttgactaaagcaggttttcacgttggcgacatttaggatggttagttttttaacacatttaaagcaaaggctttgttctctgttgagagtccaggaaaggatcctgacgtcttaagaatctgagtgacaaaatcggtgaacctgagtgaaaatttagaattggaagacatttctgttagcgtatcatcccgggtgctcctggacgcaggactctccacacgtctggttggcggtcagctcatttatgattgagcctgaccttatgacaggccacctcgttaacgattggatgttgtttttatcactctttactacgtttgctttcccacccctgctgtttccatgggtttatccgactctgcccactgaggcagcacagtcccctcgccttagcattgcgggcccagagtatctaacgcgtccgagtgcgaacagtgtcagaaggcactgaggcagcgcggttcccacctcggcattgcaggcccagagtatctaacgcgtctgcgtgtgaacagtgtcggaaggcactgaggcagcgcagtccccaccttggcattgcaggcccggagtgtcttactcatccgagtgtgaacaatgttggaaggcactgaggcagcacagtccccccacctcggcattgcggacctggagcatgtaacacgtctgagtgtgaacagcgtcagaaggcactgccgcagcgctcctgctatttttagcgtcctgctatctttagctgatagagtcaggccacggtgaggccagcaggccgctgaatctcacggaggcttcagaagttgtgatgctggcccctcagcttgcgggaactcttcgaggaaaaaaacgcgcaaactgttaatgttgtcagtgattaatctgattgaagcaaacggggaatggttgttacttttaaatggctcctgacaatggtttggccagggcttagatgtaacagtagtacttacttcttcaatagccaaagcttgaacttaggaaaatgggcagcataatttttagttacagatttgggagctggaagggtgcagagtctcatctctgtgtccatgctaagtgcagcttctcatgatggtggaggacgagtttcttcatgggaaataaaagagcccgtgggaacccttcgcagcggcccacatagaccacggaccacatgggagccgtggggctggtgacctggaagggggcatcctgcagtcacatggcaagggcgacctcggaggagtccaatctgccaggacatgggcagccgcagagcttctgtaccggaggcgatgctgttatctttatttgtgtggatctgtgattcatgtggatctgtgaagcctcatggaggccggaggacgggcattgatgagggaaggtgaggctggcaaattcctggcatggaacagtttgttctcaaagagccagctgagcccacagcagttttgtaatctggaacctcgtggctggcgtgtgatgtgatgaactcccctgctgatgcgtgaataactcctgacacatccctgttctctagtaacacggtgctaggcatgggacacacagccgcttcccaggaaactccacagcgtgagcaccgggtgcctgcgcaggtgcgggaggatggggctcccgtgcggagtctgcgcagggcctcctggtgaaattgcgcccttctggacacactgctgggtccatcacatgagcctaccatggcagatcatatatttgtaaatgaaccttaaaaggtgaggtttttaggctttcagatatttggggggaaagggtagaaaactgcccccaggaggcctgaatgaatcaagtcgtgctgcagagcagggaggattttcggaattagatgccgctgtgacggcagcaggtcggtggcagggtgggaggaagtgtgtcttcgggcagcactttctcatgggacaggtgttctttccgtagacagtctatttatttatttattttttgagacggagtcttgctaagttacccaggctggagtgctgtggcgcgatctctgctcatttgaacctctgcctcctgggctcaagtgattctcctgcctcagcctcctgagtagctgggattacaggtgcccacaccacgcccagataatttttgtatttgtagtagagacagggtttcaccatgttggccaggctggtctggaactcctgacctccagtgatccaccctcctcagcctccaaaatgctccagtgatccgcctgccttagcctcccaaagtgctgggattacaggcatgagctactgtgtccggcctcctatacagtctttcttagataaaacaggaagggttagctttattactaaagaaaacagattagctttattactaaagaaaacagaaatgccatctaagcagaaatagaaactaagtatcagaactcccttgatgactgcgccacacacttcattcccactccattcccagccaggagtccacagcccaagtctcattccagccagctgaggttctgtagttgataatcaattgcacggcactcactagttttctgttttatttatgagtaaagttttaagtgtgacgatgtaagtgaaaattcaagagtgggaactggatgtgaatcaactcattgcctatcgatggcccagcaggtactgctgtccccaaggaaggtgcgggaggagacagtaggtgtcacttatgttcatggctgtcccacgaggcctgtcacgtcctatcctatgagatccatcacatcttatcctgtgagacttacaacaacctatgctacgaacatatcacatcctatccttcaaaaaatatcccatcttgccctacaagcctctaggagcaggtgcagaagtgcacgtgaggaagggagcagtggcctgaggggtgcatgggacagtggcagtcccagcagtgtgtggggtaaacctactagatggtggagaaatgggggcgggggggggcaggtggcccatgttccggtgtgggaaggcatagcgtgcgggcactggcctccccaggtgagacagtggcccgcagcggcatcctgtgcatacctgcacctacggtgttgtgcagtgagtaaaaggctccggcatgagttcggtcctgtcgggaagttggttgggagttttagggacgtggcaataactgcgtcccaagcagctcctccattcagggcccgtgacggtctggagtcggaggagccacagaccaccttctggttcctccattgcactcaggtgggcaactttaaacgtttctaagttaaaacaaagtctaacttactgtagaatagaatgaaaacttggcataaaaatgtaagaatatatacaaaaactaaaagaaataatgtgttgtagtgggtgattagaggtcctgggccagtgagtctctctctccccatcctcttctttcctactccctgcttccctctctctccagctgtgtctctctccatctctctctctccagctctgtctctctccagctccatctctctccagctccatctctctccagctgcatctctctgcattttctcttctggcctttgtggttaaacttgagaataaaaataaaagcacttacaaatttattttatgaccatatctgcctctagtttgtttgtttgtttatttattttgagacagagtctcgctttgttgcccaggccggagtggagtggtgcgatctcggctcactgcaacctccccctcccaggttcaagcgattcttacgcctcatcctcccgagtatctgggactgcaggcgcacgccaccatgcctggctagtttttatatttttttgtcgagatggggtttcgccatgttggccaggctggtcttgaactcccgacctcaggtgattcacctgcctcggcctcccaaggtgctgtgattacaggtgtgagtcactgcacctggcctctgcctctagtttaattagtgcttatgttttatttaggtggcaggtgttgaattacagttttgattaaaacccttctattttagagttggagcaatagacacaggtttacaagttatttatataaagatttctgtacatgtttttgttctaaaaatacatttcattgttaaattgggcattagaagcacaatgatacatttcttaaagaactaattatacaggcaaacactattaatatttaacaaggcatctgtttttctccttgtccatgcgcttccccacaaaagcagagaggggaagctgaatatggcttgggggcacacggcgcggggcacagcatctccactttacttaaagatgagcagtgggtggaggattcaggcgcactgagcatgcagggcactcacaggatcctgctgtgcagatgcaggatccgcagtggggacaggatggataggactgtagagcttgtttgatgcagagattctaggcaggaatgtgaaagcctcaggtgttaagtttcactgtttttactaacactggatattaacaatttaaaacacctttgacatattttcatttgtatttcatgtcttgatggttaagagttgagctgttgagcctagttctattgttgactggctttctgctgaaaagctaacaggttaaatggtttgttaaatccagaaccttcgaggtaggcccacattatcacattaaactcacaagtgtggatcacaagtgaaggagtattgcacagaatgttttttcctttccttataaaatgcattagtctatgcaaatacaactttaggggaaaaataatatatttaaaatatattaagtttatcctatatttatatattttggtttctgttttgtctaagagctccagaaattccttgctgacattgtccaagtcagtggacagccaaatctcatttttctgactcaattctgtgattcttatcttcagagctgcttggattatttagcagtggttctctctttccttttctttccaatcttaaattagcagttctatgtttcactgatcggtcatttgtcaaacaaatactcattgagtttctattaataccattacaccaggcttttgtgttacttagttatcgagaaaatgatttcatccgggttaatgagctaaaatggcacagtagacagtgagccaccaggagagtgagtgctcctgggcttcactaactgtgctgcttccagctgataatgaggttttgtttgagaaactaagccctctggacgtggcctcccagcaggatggacatgcgagctcagctgttcccctgcttggcttttaattggtgctgggatgaggcaggtgcagggggcgggggtgaggggcagggaaagaaccttgaaatacttgagaaaagggcctttcctgcaacttggttaagaaaccgttgcaagcacaataatattgggctgaaagaggttggtcttcatggaattttagtaacccaaagtttaagacaggagtgaaatttcttgtctttatttctaatttgcaaactggaaaagtgagtctgggcagaaattgggtttctagtgcctgtcagtgacctcagccatcaaccgccgaggaactgcaggctgcccggagagtcaaaccctgactgtatcggactcaaaaaataaatatcagtgacaaatgcagacttcgaaaatgtgacccaatgctttcacactcctgtacttttcataaattagtggttttcaaagtggatagcaatatgaatatttctctttttcagtgatactgtttttctcgacaccacaaaactatcctataccctgtacttggctcacctgccctcatagccgcacttgggggggatcactatggtgcctggtggggtggcaggtgcctcctcctgaggcagcaaccccaaaaggtaagcatggttctgcccacgcccccatttccagcaggccttgtcagcggtaggaccatgaataccgactggtgagggggagtgccaggagacagagaagacggctgcccactggggcttctagtctcccttccaggaaggatttgaagtagctgacacaattaaacacaacataaaagaggactttttttaaaaaaagaaaaaagctgagaaaaatgttagcagacgtctgggatggatttagctgtgcattttctggcagtgaaggtaaaaaaggaaatctccatctgggtctaataaaaggcactccatagatacactggggaaaataaactttttcattcaagggagaattaattatagaaggacactgggaaatctaaataccataaacgggttttgctaacgtttcaagaatgttgagattgagtttttttccgttaaataaaaagttgatttctttgagtgccccgaaagccgggcattgcatggcagcccagcgatatagccttccgcgtggctgatggaggctgtttccaattgcctgagctcacacaagggcaggaattacagaacccacagccgtgatttctacgggtttgtcaacagaactccttctcaaagcattttatttgtataaatttataaattccaagtcttaacattacttagtatgaattcagtgaaaaagtaagactttagtgaacacaaaatctgaagcgagaggttgtgatgcttgctggagtcaatctgttcatttccaggttctgttttggttgcattgtgtagaggaaaccttcactcgcgcagataagaagtgctaagtggtcacagggcttagaatcctgcaccgtgcatcctcaaatagctccagaaccttgacagaggcattacagagttgaactcaccagccattgcgtgattcacctaacatcgcttacatttctcagtgtaaagttaagcagcgcaccaaacctttcagcagtcgctaagttgggctcagcactaaggagcacctgacttttccgaggtgcatccataagtcccatggtccgtgtgctcctccatgcctccgtgtgcgcatgctctgctgccgggccacctcccgcacctccgtctgcacatgcccagagcctatgcagagcctccgtatgcgcatgctcagagcaggtgcagggcctcctcccgtgcctttgtgttcgcgtgcccagagcaggtgcagagtccctttgaccttgcttaaggagcgcacaggtgtggaccatggtgccaggatgcgggttgtgagggtagcatggacagagggtgagaactcgagccctgatccaaccacactgtttgaacttgaccctatcacttagcacatgttttaactttggcacgttatctattttttcttagcttcagtttgcttgtctctaaaacggggattatatggcaccttcatgggagttgcatgatgatcaataagaaacccatatagagctgctaaatagtgtctgacacataggaacacacacaaaaaatcagctaactttataggaaaagatgttatcactgtgttttctggggtggcctggagctttcctcctgcggtagcatctcagcaacgaagcgttatcttacatgtgcttcacgttctacaatataagggggcctgagccactgatgctgttcagccaggagcaccaggcaggtgaaagagaagagagctgctgatgagaagtcctgatctttctcctcccagttaaattaaaatgtgtgttgtttccagcatgccagaattatatttataatacaattgagtgtgcaggttttctatattgagtacattttggaaatctgtcccctagtggcatgcatctaatgcactgtccattttaggcagagatgacaacaaacaaatatattactaaacttacattgagactaaaattaaaattaaactagatttaaattaaaaacttttgtgcttcaaaggacgccattatgaaattgaaaagaaaatccacaggacgggagagaggattggcagagcgcaggtctggtcagggatttgtatccagggcagcgttggaaggctgtggagctgtgggaacccatatgtgcctctggtgggagcattcaaaaccatttcagaaaactgtttggcagtttccagtaaatatatgctcctggaaacaacccacatgtctatcaacagtagaaaaaaacaaaaataaatcgtgaaatgttcacattaaataaaatgaacaaacaacatgggtgacttttgacagcctaaacaaggaaaagaagccagacaggaagagtatgttataagattcattgatgtgaggttcaaagctgggcactcctgggggatggaggcagaggtcaaagtggatgagaccttggcaggtgggagggtccacagtcacaacaggggcatctcagatgctggtgatgctgtgtttcttggccctgatgacagtggttacccaggtgaaggctgagccgcacacccagggcaggttaggcactttgtgagcaagttatccttcggtgaaatgttcgttaaaacagatcatgactcatgtggcgttaaatattacagggaaacctccagaagggatgggcttccagggacggtttggcaagggccagctatgctgagctgccgtggtcataaagaccagaaggagaggagggaaggggctgggctgaggaacagcatgggcagaggccccaagacaggactcagcttggctgtgtctgaggagccatcagacagggaggtcaccgagggcctcgtctgccttctccttttatctgagtggatggaaacctcggagggttttgagaagaggacaaaacaagcaggctgtaaggttacatggtcactctggtttgtattgagaataactgcagtgggctcagtggtgagctcaggtggaagcagctccgtgtcttggattgacaaacacaggtttgctgccagtgctacagcggtcagcctggtcctgtgcctccataactggcctctctgctttttcgtggtgcagggaaatgctgcttccggaagcccattcatagtctcctctgtagcctggaattgacccttgaagagttcacaggtcctctccctcagcccttttacttttttctgaacccaagctatggtcagaagcactcaacattcccatatctgttcagcgccggcttcccaaagctctttgcctcgggttgaaatagctccaacttgggctgggcacagtggcttatgcctataatcctagcactttgggaggctgaggcaggcagatcatttgaggtcagaagtttgagaccagcctggccaaacatggtgaaaccccgtctctactaaaaatacaaaaattagccaggtgtgttggtgggtgcctgtaatcccagctactcgggaggctgaggcaggagaattgcttgcacccaggaagcagaggttgcagtgaattgagatcacgccacggcactccaacctggacgacaagagtgaaacaccgtctcaaaaagaaaagaaaagaaatagctccaacttaaagtgttagcgactcagaaaagtatttacccctctgctcgtagagtattgaacgaacctgagattattgccataatttactgcaaataggaaaagcaatgtgagctggggacattttgcttgtttcttctcaccagagcagtgccgcagataagccgactggcttcatgcagcgcagagctcctttaagcattgtgggacaggtggatctgccaagcaggagctttctgtgctggcccaaggcaatgtggctcagttctagcccctctgaccctattctgctgccggtatgcccccacccacctgcctccccgtccccctcctcctcccccaggtcccagccgtcagccgtgttgttttgctcactgtgggatgactgttcccatagaggctgtttctcctgccccgcccctacagagcctcccttctcgtgtcccactgtgagtctaggttggcccatgcagttctggggcctgctgtatgtcttcttcccctagtgaaacagcagattccttggggtaggaagtggcgtctcacctgtctcacctactccatggagcctagcagaggactaagtatactgcagatacttaggacttactttattgagttgactgcagaaaacacagggacaaatcatggtgaccttggattaggcgatcttttcttagatatggtataaaaagcataagcaaccaaagaaaaagatagataaattggactagattaaaattaaagacttttgttcctcaaaggacaccattacgaaagtgaaaagaaaatccacagaatgggagagaagattggcagagagtggctctggtcaggcatttgcatccagaagacacaaagaactctgtcaactcataacaaaatgatgctctaatctaaccgtgggcaaaagattttaattggtgttttaccaaggaggaatacaaagggccagccaatgaatgaaaagatggtcaacattatttgcatttatttacattagagaaatgcaaataaaaactttatgcttcatacccactaagagggctgtaataaaaaagacagacaatgaagaggtgttaaggaggatgtagaggagttggaagtcttgtgcattgctggtttggaatgtaaaatggtgaagctgctcggaaacacttggcaattcctcgaaatacaggaatatgaagagttaccaatatgccctgcaattccacgcctaaatatgtcctcaaagcattgaaaacacgcgtccacacggaaactttcacacagatgttcttgtgttcttggcagcattattcatcatagccaaagagcggaagcatctcagatgcccatcagtagacgaatgggtaaacaatgtgatttatccttacaatggagtagtattcagccacaaaaaggaacgaagtactgatttatgtacaccatgaatgaactttgaaagcatgatgctaagtgaaggaagctagaaataaaaggccacacgttgtatgattctatttatgtgacatgtccagaactggcaaatttgtagggacagaaagtagattaatggttggcaggggctgggggagggggcgtgggagcgactgtaggtcttgtgccttcttgggatgatgaaaatgctctagaattagatggtggtgacgattgtgcaattctgtaaatgaactaaaaaaccactgaattgtacattgtaaagggtgaattttatagcatgtgaattctctctctctctctctctctctatatatatatatatatatatagatatctatatgtatatatatttttttgagacggagtctcgctctgttgcccaggctggagtggaatggtgctatctcggctcattgcaacctcatcccaggttcaagtgattctcctgcctcagcctcctgagtagctgggattactggcgcaccaccacacccggctaattttgtatttttagtagagacagggtttcgccatgttggccaggctggtcttgaactcctgacctcaggtgatccacccacctcagcctcccaaagtgctgggattccaggcatgagctactgtctcggcccaaatctttcttaagttgtgtctggcctttggcagaaatagccacaaagccagggtaggaacgttttactcttcaagtgatgatggcatccgataaccttttagagggaggttttaaaatgcaacgtagcccagggctccagaaaaagacctgcacggagaagagagggctttgtagctctcagcagacaaggcgtgctgcccagggagctcagttttcactgtaactgggttgcactgtcaccaccggtctcctccccacagatcccacgggaggacttcctgttgtgtaacatccagagaagcttctggaagctggggagctctggctgtgcaggaaagatctagctgttttgttgcagaaggcgctcgccatcagggtcccgggtcgttgacccacccacttccgctgctgacgtcatgctgcgctcagcgttattcagggcggaattttcactcgtcagaaatggatttgggagcattttaaaatagtgcgttttcagaatttttgtggttgtctgagaaccaaacaagcaaggcacagcacgggtctgaatcacttacatgggccttgtttgcttgtttaggtcagtgtttctaatactttatatttctaatgtaaagccaaagaaagccacaaagagatttaagatgtgggtggaagtgctctgtttgctgtgtctgtgtttccacagagctttatgtttttttgggaggctggggactggggaggtgagggacatggagctgtagtcgggagggttgggcagccacactgggggtggagaaggtggcccggtccctgcggggctgtggggcaggagctgtagtcgggagggttgggcagccacaccagggatggagaaggtggcctggtccctgcggggctgtggggcagaagctgtagtcgggagggttgggcagccacactggggtggagaaggtggcccggtccctgcggggctgtggggcagatgaactctctgggggcacctgtcatggtggagggcagagaacaatggtccagcaccattaccctggcctgggctgctccaggctgcccgttgcatcagcggtggagggtggaggcactagccaactggggcaggccatagcctcactgtgggctggagactccgtccctgtgctgatctgggacaggtgggctgcagggagactcaggggcccgtgctccttagtcgtttgttcccgccaagccacctctctctctgcccatattcagtggatgccggctgtttttgtttgtggctctctctgcactgttttccatctgcctctgtgcatcagggcctttaatgttttaccgggtattttgagcctcacagtgactgttccgggtccaggggagtaaagagtgctctgctccctgtggaggtgtacttctcttcccccaaagattgctcctcttccccagagcgctcctcttcctccatagactgctccccttccccacggaagagcgctccccttccccacggaagagtggttcccccaccacagaagagtggtccccctccccacagaagagtgctccccttcccccacaggggagtgctccccctccccacagtgcgcttttctcacgtgtcctaagtatgggtggtgcggggtgaacgcattgtccacagggagcagccacccctggaggcaaacaggaacactcattcttgatctagatggtgccaggttgaaaggaggtttttaaaataagtgcaggctcatgtagagatggctgctgcctggcctgatgttgcatgggaaatgcagcatgggaacccttggggggtgggggagacacctcctgtggaagggggtgctgtcctgtcacctcccatgtcgagttgcgcctgagacactagtgtctgtgctgctcagcatgtggtcccacggaggagcccctgcgggcgctggtctctgtgggagactggggtgtgagcacgcggtgtcacaggtcgtgtgtggggggacttatgacaggtgctgtctgatttcgtagtctggatgttcattagcattaatttcaggcactggacgaccaaaagtgagaaaagggaaaacctgagaatttgctcagctgtgtaaaaatgatgccacttacgataattctgcgaagctaccgcttatgccagctacctgtggagcgcaacatcggcttcctgaggcagtctcagcctgctccattttatttcacttagatggtatcccccgtgtgtgacggccggccttcgccctgtgcctccccgcagtgtggctggatctcagggggctcggacacgtgctcagactgaaggtcagaaagagcattttccattctgacccctgacaatggcaagactttccacaggtagacacctgtttttccaatccttactgtgtagcgagactttctgcagatagacacctgtttttccttattgtgtacgtgggcagaggggagaggcactcactcaagaatttcctagatgtctgatacagaactcaccctgtgaatctagttaggtttctaagcatcagtagcacagtgtatgacagcacatgtgccagcagacctcacctgtgcagagggttctatggagaggcgaagtcgttagcctgctgtggcttctctggggaagattcagactggcagacagttgctccagtgccctcatccttgatctgcttactccctgtgatgaacacatgtattttgtgagatgtctgccacatgggtgggaaacgtgtattttcaccatcgtgaaaaaaatatggctgtattcaatagcattgctggaaaatagaatgggctgagggaggtttttaagggtgtggttattgggcagatgttgcaggttcctgctacagtgtgatgatctgtgcagatgttgtaggttcctgctagcactgacggcataggcaggtgttgtatgttcctgcaggttcctgctagcactgatggcataggcaggtgttgtaggttcctgctacagtgtgtgataacctgtgcagatgttgtaggttcctgctagcgttgacggcataggcaggtgttgtaggttcctgctacagtgtgatgacctgtgtagatgctgtaggttcctgctagcactgacggcataggcaggtgttgtaggttcctgctagagtgtgataacctgtgcgatgttgcaggttcctgctagcactgacagcataggcaggtgttgtaggttcctgctagagttgacggcttaggcagatgtaggttcctttgagctcaggaatgtaacacagtaagcttaaggtaacctatacagcttcaggaaaagaggattggttgtttatttcctgtggtctcagggtgtccttccctggagtttagtataggcccatccaccatccagaggcttcattttgaatttggggagtttgctaagaactttaaccaggtctgaaggaaaaaggggagttgtgcatttgtaaagtatttggttttgattgaaccaacagtgcaagttacaggttaagccagttttcaggttagaatatttcctgctggtatggacgtggtcattttagtcatcatactatgacggctgagctgcgtgtccagctgcggtgagtgggccacttgcctctttcacgtaaggaaggcttcctcttcacgcatttgtcagtggtcaagaaagttaaaacaagaaggcaggagaatgtcgctgtcctcccagcacccggtttgggacggtctgggagggtgtgatggagtgcagtgttctgtatgttgatgtgtgttgacggatttctctgtcctcccggcacccggcttgggacggtctgggagggtgtgatggagtatggtgttctgtatattgatgtgtgttgatggatttttctttcctcccggcacccggcttcggatggtctgggagggtgtgatggagtgcagtgttctgtatgttgatgtgtgttgatggatttctctgagtggcgatttcagggatgcttatttctgtccagtgaatctcagacatggggagcctaatcttcacatttggtgactctccctggcagcttctcacgtgaaagctgattgttagctgctggtgcctccctccccggccctctgctcaccacctgccctcacgggtgagccgctgcacttctcgggctcgttggcctgcagtcagctctcggctcggtgctgtggaggtgttttgcttttgccaggaaagtgcatcctccacaccttccctcctggtcgactcttagtcacccggctggtgtgtaaagcacagagtgctctgaacagtgttccaagtgtgtcccaagttaaaacgttgtggttagccaactccagttcaaattccttccctacttcatgtaagatatgtgagctctccagcctcaatttcttcaactgggaaatgaaaataacagggatgtccctttcaaacaatggtgagttttaaatgtgatcatacatctgggagtcttaaaatagtacgtggcacacagtgattcatcagaaaatgtgaggattttactgatggggtaattgggcactggatagctaagacttactagtttcgagataagttagtagcataataataataactattactattatttgagacggagtcttactctgttgctgaggctggagtgcagtggtgccatctcggctcactgcaatctccgcttcctgggttcaagcaattctcctgcctcagcctcccaagtagctgagactacaggcgcccgctaccacgcctggctaatttttgtatttttagtagagacagggtttcaccatgttggccaggctggtcttgaactcctgacctcaggtgattcacccacctgggcctcccaaagtgtggggattacaggcgtgagccaccgccccagcccataatcagaattagaatgtagctatttaaaattttatcccagtgttttaaagtatgtttagagtattagtaccacccaaataaataatcattcattcttttattcagttggtaataatgtgaatgtttagtgagtactaagctcttactgtgtaccctagtatgaagagaataaaaggatgcacaataaatatacatcccctaatcagagacagtttcaaattttagtttataatttgtaggtgttcctcctcacagctatatattagaatcatatgagaatgagtgaggaaagccaaaaaaacaaaaggatcatcgagaagcataaaacaaaaagattaggagcggtgagaggcaggacccaggcttggtattgttatgttttaaataattttctaaagttttgaattgtaaaaaaagcatgcatggaactgaccatcatagccatgttaagtgtacagttcagcagtattgagcacctccacattgtcgtgcagcggaactccagaaattctccgtcttgcaaaactcagcctctgggccgttaaactaggtgtccccacctcccctcccccaggccctggtgaccaccgttctgctttctctgtctgtgattttgaccactttagatacgtcatttcagtggactcatcctgtgtcgttttgtggcggaatcacgttctgttgtgtgtatacaccacgtttttcttgtccgttcacctgtgatggactcttgggcgtctgccgtaggccgctgtgaatgctggcggcggtgatcgtgtgctgacgtctcctccacgtactgagttcgtgtcttttggatgcgcgcccagaggtggcactgctggatcctgtgctgggtcatacctatgtttaattctctgaggaacctccgtgctgtctccatagcagccgtgtcgtttcacacttgcaccaacagtgcacagggctccggttccccacgtcctcaccgggtaactggggttccggctccccacgtcctccccgggtaactggggttccggttccccacgtcctcaccgggtaactggggttccggctccccgcgtcctccccgggtaactggggctctggttccccacgtcctcaccggcacttggcactgtctagtgttttggtagcagccatcctgctccgtgtaggtagtatctcattgtggggttttgttgttgttttttagagacagcacctcgctctcttacccaggctggagtgcagtggcacaaccatacctcactgcagcttcgacctcctgggctcaagcgatcctcccacctcagtctccccagtagctgggatcacaggcgtgcaccaccatgcctggctaattaaaaaaaaaaaaaaaaaaagacaactttttttggagagggagggtctcattaggttgctcaggctggtattgaactcaagtgatcctcctacgttgacctccctaagtgctgggattacagctgtgagctgctgtgcctggcctcattgtggttttaatttgagcacttttcatctccttattagaccttcttgctacaaatgtctattgaggttctttgcctattttaaaatcgggtaattgatttttttctgtcattggcttgcattggcatagtttttttttttttaacttcctaagtggtactgacgtgtggccggggtgaaaacctctggcctaggtatggaacaggtagagggtgttaccgagatgatgagtaggagtgttcagaaggtggtagggatcacccgtctgctccggagggatcgcttgttgagatgagatgaacgctgcacttgtggacatgcagacgtcttgcaaacaagtggggtcaggatgtggtactcaggtgcagcctcagggccagggtggattcgggagcgtaagggaagggactgttgctggaaagaaaagtaggtattgaaggaggtggaggcaaaacagtccctgcacctctccacctgcagactcagctgccgccactgcagcctcccggagcttggcgtccacgggtaaggacctccctcagcttgtgggcaacatgtcttcagccagcgtgccaagaaactgcaaaggcaaaatagtgtttttggcagtgtttcaaagaaacagagagtgcattatgtgcacattcaatagccctactgtagctttttagcaaattacaaaaagtaacacagggcctggtatggtggctcatgcttgtaatccctgcactttgggaggccaaggccggcggatcacttgaggtcaggagttcgagaccggcctggccaacatggggaaaccccatctctactaaaagtacaaaaattagccaggcattgtggtgcacgcctgtaatcccagctactcgggaggctgaggcaggagaattgcttgaacctgggaggcggtggttgcagtgttcagagatcacgccattgcactccattcggacggacagagtgtaagactccatctcaaaaaaaaaacaaaacaaaacgaaggaacacaggattgtatgcagaaagaaagggtaaggcaaaattgaagggatgggatgaatttgagcatccctcattccaaaatcccaaatccaaaatgcccaaaaatctgaaacttttcaagcaccagcatgatgccacaagtggaaaattccattcataagctgttgacacaaactttcatgcataaaattatttaaaatattgtataaaattaccatcaggctgtgtgtatgaggtgtgtgtgaaacacaaatgaattttgtgtttagatttgggtctcatcacaaggtatctcatgatgcatatgcaaatgtcccaaaatccaaagcacatctggtcccaagcattttggataagggctactcaacctgtatttatagacagaagctagaaggcatttgtgggactctcaaactaagatgggtcttcattaccttctaactttggcgatcatgtagtagatatatttattctgagaaacaatcataaatataaatgcatttctttcatttctttttattgagatgggatcttgctctgttgtgcaggctggagagcaatagcatgatctcagcttactgcagcctccgcctcctgggctcaagcaatcctcccatctcagcctccagagtagctgagactgtaggtatgcgctcccacacccagccaatttttgtattctttgtagagacagggttctgctctgtcacccaggctggtctcagactcctggactcatgcgatccattcgccgaggcctccaaaagtgctgggattacaagcgtgagccaccacgcccggcctgaatgcaatttttacattatagtcatttatgcttcttcctgttaatccgaaataagcaattgtgtttttgctagccagctacagagataatgtaaaaaatgttttaaaaccatattatcaagcagaaaatggtgcttgtagatcaatatcttcaacagtttcccattaaaatttcagtatgtggtcggatctaactactggaggagcttcgaggtcatgccagtgtccttaacactcgcgtttgttaaagacagccactgccgccctttgcggctatgtgcctcacctcttccacatcacggagcacacacagaatgttgccatttgagccatgcactgggtcacgggtgggctgggcgtcagggtgcccacagctggagtgacctacagagcccagctctgctggggccccagggcaggtggctgcagcgtccccagcggcctccctggcgtgccacagcatgaggctgtctgctctggtggatgccgtgggccatggatgcgcctccatctccgcacagtgcagccggtctagctccctaagccgccaggctctgtgcccaactcaagcagcagccaagtggagagagctggaatgtgtcatccctggtcccagccttctatttcttaatagaaattaagaacttctgccacgcttaaaagaataagggaaactttcatttcgtagcattctaacttttattttaaaagtctttcactattgaatgactttcctgaattaactacattctcaaaaatattcccagcattggtcaaaggcttaaggaattttttactaaaagttgcaacttgttgagtattaaaagtcttacagataaaaataagcaaaggagatttacagaactcagaaaagaagagaagacacagatatgctttggggaaagtactgaacctagatattaatcagagaaaagctgggaacgttgattcctaggaatgtggatactgtgttaggaagagaaagggaaggagagtctccatcctcccacgtggggacacgtctgctgaaggatgcggggttgaatccccttcagcctctcgtgaatttctgtcttagggaaggagaatctccatcctcccacgtggggacacgcctgctgaaggatgcggggttgaatccccttcagcctctcgtgaatttctgtcttagggaaggagagtctccatcctcccatgtggggacacgcctgctgaaggacgcggggttgaatcccccttcagcctctcgtgaatttctgtcttagggaaggagagtctccatcctcccacgtggggacatgcctgctgaaggaagcggggttgaatcccccttcagcctctcgtgaatttctgtcttagggaaggagagtctccatcctcccacgtggggacacgcctgctgaaggatgcggggttgagtccccttcagcctctcgtgaatttctgtcttagggaaggagagtctccatcctcccacgtggggacacgcctgctgaaggatgcggggttgagtccccttcagcctctcgtgaatttctgtcttagggaaggagagtctccatcctcccacgtggggacacgcctgctgaaggatgcggggttgagtccccttcagcctctcgtgaatttctgtcttagggaaggagagtctccatcctcccacgtggggacacgcctgctgaaggatgcgggtttgaatccccttcagcctctcgtgaatttctgtcttagggaaggagagtctccatcctcccacgtggggacacgcctgctgaaggacgcggggttgaatccctcttcagcctctcgtgaatttctgtcttagggaaggagagtctccatcctcccacgtggggacacgcctgctgaaggatgcgggtttgaatccccttcagcctctcgtgaatttctgtcttagggaaggagagtctccatcctcccacgtggggacacgcctgctgaaggacgcggggttgaatcccccttcagcctctcgtgaatttctcagtctttcagtccactttgctcactagtgtttactgcactaggttttcgtttgggagaataacaaagcctcctttgagttcggggaaggttggaagtggaagctgcctgtttgggagagatgacttctgacctcttctgggtcacgtagcttccccctgcctttttataacaagtagaattgttatgataattaccgtcatcatgatatttttatttatcattatcctctccttcatcaaacatttatagagcaattaattctgtgccattctaacttcatcggtgtaatgtcatcatgaggtacaatagcattattattcccactttagagatgggaattgaggcataacacgtagacggctgcccactgtggaggagctgaaccttggcggtggggccgcagggtctctctgctccctgtgggaccgcccttttctcactgttgtgagcagggctgttcctttccagcaagatgaacaccggtgtaagcgcgtcttcgtgtccttccatggatgtttgtagaggtggagctactgtgtcgaaaggcatgtgtcttggtattgtttgtttactgctaaattgccaccgtacgtttttcttccatgaacagcctgcgaatacaccctgccatttgtttattgggctgttcatttttttctcttgatttgtgagagctctttttatattaaataaattagcccttgccaggtacagtgtggctgatgcctgtaaacccagcactttgggaggctgagttgggtggattgtttgaggccagcaatttgagaccagcctggccaacatggtgaaaccccatctctattaaaaatacaaaaattagccggatgtggtgacgcgcacctgtaatcccagctactagggaggctgaggcatgagaatcacttgaacccggaaggtggaggttgcagtgagccgagatcgcaccagtgcacttcagcctgggcgacagtgaggctccatctcaaaaacaaaacaaaacaaaacaaaaaaaaaaacagacattggccctttgactgatatgcatactgcagataatcccccccccctttttttgagacagggtcttactctgtcacccaggctggagtgcagtgctgtgatcccgcgtcactgcagcctggttccagtgattctcccgcctcagagtgctgggactacaggcatcagccactgtgactggcctcccagtttttcatttgtcttttgacattatggtatacacatacacacatgcgtgtgtgtaaatacacaaatatatatgtcattgcatctttgtaaataacgatgtggctaagtcgttcatcttttcctgagccctggagtgccccatgcttttaagggaccccttccccctttccacaggtataagcctttcaggaattggtctagtattggtcattcatttgttaggaaattaggatgtttcctttcttagggcctctcactgtaaaccctgtgtctgattatgtcataaatggcctgcctcgtttcaaggtgggggacgtctggcagcagagaagtcacaacagtgacggcggctgtgtcaggtggggatgtacatggagaagaaaatggggcaggacagtggggctcggggccgggaggagggcagcctttttctgtgctgcagtcaggaaggcctcctgcgaggacctgtttgagcacaggagtgacatgcagcgccattcccaaagtctcctgggttcccgggggtggagagtgcagctcaggagaatcctcccggcgggcgcccctgtgtggagcgggtacccctgtgcctggtgggcgcccctgtgcggagcgggctgtgagggacgggggctcctctttctgtccccacccccagcctgctgccatcgtcttcagcactgaatacgcgtccgtctgacgggttgtgtatttctatgtgagaaaattaatgaggaattttactgagagttgttctgaccatacaaacttaattgccctttcagtggaatgaaccacacatttctacaacacagaataccgtaatgtagtttaatagcctggaatagcagtaggatgccaagaatttactttccaccgccgataaccacagtgtccttgctggccatcctacaattgctaaagagaatgtagttgtcagtgtagcatcgggactttccaggaaagtcagccaggatgcacccacctgggagtggcttccgcctggcctccagcagctgccgaaggagccgtgtcctttggagttaatggagggactggctgtgtattcaatcacatatgctacatggtctacacatcctgcccacaggtgagttaacaggtcatcttttcatctttcactctaagtcttggggcaggaggtagaagtcagtgacatcaggcccagggtaaatgagtcagtgttcccaatgacatatacggtggcttacagttaccccggcccagacttttttctctctgtccctccgtccctttgtacctgcgtgttatgtggatggcgtgcatgtgtctgcacagctgcgtgatgttcccctgtggactcaacctcccccgcccctggccgccccacatcatggacagctgggctccaatcttctgcttttataaatagtgctgcagatgccttgtgagtacatcagctatatttctgcgaggacagctttgggatcgctttggagaagggagatttctgagaaggggggtacgtttgcggtttgctctgtcagtgccgtaggaggatgcctgttctccacctacctcgccagcagcctgcgctgcccggcttgccagcttctgggcctgcctaccgctgctggatgagatgccacgtcctgttgtggttttatcttgtacttctcctgctaacaggcaggttgagaatctttttatgtgtttaagtccatttgctgttcttttctcttttttgaaaaagaacagcttgtttatatcttttgcccatctttcatttgggttgtgtcttgaggagctctttatatacttctttattcttgatatttttgtgtgcctgattcctgacatatttattattaataataatggagcaataaagtgagtcacataaaaaaaataatggagacagtgattcccaggccaagagacacataaattatttaactgcagtcaaacaggcttatgttagaagcgctttttccaaaatgcaatgtagagttatttaaatttaaaaacatgctgaggaattaaagaaagaagccatctatgttcttcctggggcatcatttgagctcattacgtggacaccgctgcctctgaagctggttctgccacacgcctgacaggccgatcacagcctgaccttgaccaggcagcatccagggcgtcgctgtctcaccgtggtccccagtgttttgggattgaggaggggttcggcttcactctcttcagcgcctggggccttcatcctgagccgcagttggagccacggtccctgctgctgagatgtgagaaaggcctgcgctggggtctgggaaattcgttttctcgcagaaggcagagaaggccgtggaataacagggccgggttctcactggcgggactgttcacctctgcaatctgccccttagtgcctcggctgattcttggtctttggagacctggtccccagtcccacctctgcatatgcctccagataacgctcgccatgtttggggtgtatgagcatgctccttgcgttcactgtcacccaggcatccctcccagcggccctgtgaggcaggtgccaccccacagccctgctctcccgccgaggaaactgagtactgggctaattcacctgccaaagctgcatgcttggaaagtggtgcttagagccaggcaggactcactgcggctcctgtgctccacgctgcccccccgagaggcagaactttctcaggccaccttcagggcctcctggagaggttgagccccagactcctgggaagctgttcccccacgttctgtactccactcacaggtggacccatcgcctccaaagcctgtgggtctcattggctggaatgtctcacactgcagggcacctggccacccaggggcgtgtcacaaatgcgggcggggggcagggctccaccccacaagcctgctcaggaggcctctccacgatccacaatcgaccacctgtccatggagctccgggaatgctggcccggccccactgcagggcttccccagccctcctagacaccctgcacttgcccctcccgagcgcgtgtgcctgacctgctccgcggtgggcgcagagctcctgccgagggctggatggcgcggacctgggcatcgtggcctctgcagtgccagctgtgccctagtagccagggcgccgtcgtcagtccatggctcaggaggaccactgtgggccgatgaaatgcgactgtggacgaggaaattgtactttccgaacattttcacgtgtccccaaacagttacttttcttttgatttttttcaaccatttaaggacgtaaaagcattctcagttcatggaccacacagacaggctgcaggctgcacgtggactgggggcgggtctgtgggcctctgcttcacaggtcagaggtcgctgggttttcgtgtcttctgctttccattgcacagtcccaccctctccttggatcctagaactctgcccagcttggacagtctctctacacccagagaccggttttccgcttcttgtctgcgtcccttgtagcagtcacccacagggcgcttgccagaggacggccccgaactgcctatgggatccctccaggtcctctcagagcctccgtttcttgcatgtaaaattgacacaagaagagcctccctgcaggactgcagccaaggttagccagaaccatttccagtcacggaaccgtcactcagagcagctcccagaaccatttccaatcatggaagcgtcactcagagcggctcctagaaccatttccagtcagggaagcatcaatcagagcggctcccagaaccatttccggtcacggaaccatcactcagagcggctcccagaaccatttccggtcacggaagcggcactcagagcggctcccagaaccatttccggtcacggaagcggcactcagagcggctcccagaaccatttcccgtcacggaagcggcactcagagcggctcccagaaccatttccggtcacggaagcggcactcagagcggctcccagaaccatttcccgtcacggaagcggcactcagagcggctcccagaaccatttccggtcacggaagcggcactcagagcggctcccagaaccatttccggtcacggaaacggcactcagagcggctcccagaaccatttccggtcacggaagcgtcactcagagcagattctagaatcatttccagtcatggaagcattacttagagcagcgtaaatttcttagcaaccctggtgttgacatatgttgattataatgatatccttacaacattaaactacaaagccaaaaccaaaatacaaattaaataaaacttagtctgtgaaacaggttagattccaggcagggtctacgattctggctggctgtgcgaatcgacctctgaccccaaataactaagggtcatgtccatcgttgcggtgccttcaggaaaggggaaagtgtttttcctggcagttctttctctctagaccctgcaggccacctctctcacctgcgtgttgggcttcaggatcagggtccccttccagtccaggagaggcacctgtatctgccttctgcccagagtgtgtgtgcttgttgagtctgaccactcactggggcgctctcttggtaacagggtccctgtcacctagaccttacctcccagggtctagcggatggcggggcaggtgggggacggcacgaaaaacagcagacacgatttcagaccgctggtggcggctgagctcaggtgggcctcacctggagagcctggacggtgtcagaggtgcttcttggctggtggctgaggcttcccagatgcctctttgcctttcttctggggcacggccctctgcaccccagggcagcctgtgtggtgtctgacgatttccacagcagccagagcagcttgtggcagccggggcctgctcccagcgaggggtctgctcccagcacggggcctgctcccagcgcggggtctgctcccagcacgtggtctgctcccagcacggggcctgctcccagcgcggggcctgctcctaacgcatccactacatctagtaatttactagttgaaattgttacatactagttacatcgtttacaaaatgatcatatttgaagaattagctttctgtggatttagtccacattgatgtgagcacctactgtacatgagatagcatgctaagtgctttttatttatttaggcaaaagataaaaagttactgctgctacaatctgtagtgttactggtggagctatgcaagctcgtggatttagggagtccagcctacgagaatggccgcctgtgacagaaagcaggggcgagcgtctgggaatagagctgtgctcatggcagaacaaagacgtgctgtgtttctggcctttgtgttctctccagtggtgaacaaacataggaagctttcatcttcagagtaaacagaaattccaaacccatttcacgcagctttttctagaaggcaatgtgtttaatccacttgttttccgagtctcttagtgtcatcacgacttcctcttatgtcggtgttaattactgtcacaggtatttgcgaaaactacaaggtctattcaggtcaagactagcttctctatttccacattttactttgtgtttccacaactgggctgttttagacctctgcagaggagaactgatttgaatcgggaaaagcaggaggtcccctcacggaggtggacaggacgcccactcctttcccaggctggcctccttgtctcatccctcaagggaagggccaggggcacggaccagcaggccagttgttcagtgttcaggaatctcaggagacattgttaaacattaaattacaaaaacaattaagttgtattaaaaagaaaagtctttaaaaatacctactcaaaacgtctttcttcctgattgtcttgctgagtgtttcgctgcagtctgtgcttccaaggatggcgtcatgtgtgtgcggcagaaaggcgaggttctggcaagagtgagtggctttaggtctgcacgctgtgttaggggagccaggggccagcgtggtggggttcccagagagctgcttctgaacttccagaagcttccagggagtccacgccacatgcacgagtgcgggacacatgctactcaggttccatccaagtctcaacctttgtttttacactaaagacatttttgttgttgtttttgagacagagtcttgctctgttgccaggctggagtgcagtggcacgatctcggctcattgcaacctacacttcccaggttcaagcaattctcctgcctcaacctcccaactagctgggattacaggcacgcaccaccatgcctggctagtttttgtatttttagtagagacagggtttcaccatgttggccaggctggtctcgaactcctgacctcaggtgatccacccacccctgcctcccaaagtgctgggattacaggcttgagccaccacacctggccactaaggacatttgaagtaagaagaatggatcagtaaacacttcacatttctttttttttcttttttttcttttttttttgagacagagtctctctctgtcgcccaggctggagtgcagtggcacaatctcggctcactgcaagctctgcctcctgggttcacgacattctcctgcctcagcctcccgagtagctgggactacaggcgcccgccaccatgcccggctaattttttgtatttttagtagagatggggtttcaccgtgttagccaggatggtctcgatctcctgacctcatgatccgcccatctcggcctcccaaagtgctgggattacaggcgtgagccaccgctcccagcctacatttcttaaatctatcttgctagctcctctcgcacttgaaatcaaatactccagcaactaacacttgtgaagcatttttcaattttcctgcacagttacattatctcagaacggttcattaccgtggggtgtgtgctcttcataaatgcaaactgatgcagaagcagccaccagccaaaaaatcggctttagaacgtacagttttgtagccttcattttttacgttacattttcagttaagatgtgaaaatcattgaaccaattcatttaataaaaagttgagtaacatttatattttgtcacttccgtgggtaaacataacaccaaatacttctcttgtaaaaacagcaacgtgtgcagggtatagaaattcatccattcccctgtcccctcttatccttggtgaggactcagaggtttgctgcagaaacattcgtgcctgcaagcaaaggaaaggattagagcaggaggcggctgggggagctctgggtaactctgggtggatgaggccacatcctgcagccctctggtgaggttcttcctgttgcgtgctggggtttaaacctggatctgtcttgctctgaagcagaggctctcacctgggagcagtcttgttccagccacccgcaacacacttggcagagtccggagacttctgaccgtcatgacggtgggggttgctcccaagaccctgctctgaagacttcctaacctgcgtgctctttcaacaatagcgcgtggacacatttttaacctgagcgatgtaacaaattcagccagctgtgacgatgacttttcagttttacattaacagttcattgaacttatacaccagtaaaacttctgtatcactgtgaagggctcagcaaatgtactttcatttattgatgcagaaattggagattggtactctttatcatctgcttactgtgtaaaggatgtttccaggatgatctagaaggttttcagtgcctgttttgtaaacttttaatttttttaatagaacaattttattttttcctattttgccaagaagacagaatgaagtcaattccgaaatggcaaattcttctgtttataaaatgttataaacattttatcaccagataatcacgttaatttttgtaaacgcccttgggtaggttattcgcacaagttatgcatttttcatgtgagttgcttttcacttaaaaagtgcatgcaacagaaagcaccaccttgtcgaatcgatgtgctgagctaattcctgtcatcattaactggacaggaaccgaaggaagccgtctggcaatatgccttagggtggcagatgcagcttggggcttaaaggaagagaaatagaaagatttgactctgttgaagagcagtgtgtcatccccgagccggattccatttaacatcttataaacaaaacgtgagtcttttcatttctcagtcttccgtgtaagcaatccagaaagtgggaataaaagtaatttctcttgtttttctctaattattcaaaattcatagtagtacagttgaggaaggggcacctcgctgtgagtttcatgcttcccttcgtccaggcgctgctgtgtcctgggtgctgtgtgtatagggcccccgccgagtccagtgtgggtggcagagacgcatccagaagcccccagtaagtttagcattacccatttgggtgaggactatggaagaagagttcctggtgatttcagtaaaaaagatgttttacatgccagatagaaacatgctcaaatgataacaacatgatttgggttgggttattaagttgtttttttaatgttctttttaaaaaagatttgatctcaatgtaaacaaacttgcctaatttttttcagctagttcacacagacattcaatatgcattcatcagctggccctgttccctcttcttgctcagaggctggaagaacttcccatgcaccaggtcatgtttgcgtaaatataattacactgtattatgtaaatatagttaccagcatagttgttaacagttctgccaataaatatttattgctttgatctgaatttgataatcaaactgagatttaaaacacagtggcccgggaagaatcaaaggaaattgtaacgacacattcctcattccttcagtccacaggactttttagatgttgttgggaggtggagtggggatgatgaccccttagccacagtttccctttctgtagtttcagttacttgagataaccgaggtatgaaaatattaacaggaaaattccagaaataaacaattcccaagttttaacttgtgcacccttctggggagcgtggtgaaacctggctccgcctgctccatcgctccagggactgaaccctcccttcgtccagcgtctccaggctgcggacgctccccaccccccttatggcctctcggttatcagatccgtggtccaggggtcgcagtgctcgtgttcaaggaaccctcatttgacttcatcatggccccaaagcacaagagcagtgaggcaggcaatgcgggtacacctaagagaagccagaaggtgctcctttaagtgaaaagtgaaagttctcgacttaataaggaaaaagaaaatggtacgctcagcaatctcaggagatgttgttatgttgccaagatctccagtcagatggaatcttctctctgtgaaactgggaacagcatattgttataattgttctattttattattagttattgttaatctcttactgtgcctaatttataaattaaactttatcaggggtgtgtgttcatagggaaaacattgtgtccataggattcggtactctattggtttcaggaatgccctggggtcttggaagcacccctgaggataaaggggacatcgtgcacataggtttgggtactatctcggattcaggagtcccctggggtcttagaagcacccctgaggataaaggggacatcgtgcacataggtttgggtactatctcggattcaggaatctcctggggtcttggaggtgcccctgaggataagggggttgctgcacccacaccattgcacaccttagtctgtcacttgtcagccggtgtggccccggctggaacactgtggctcattctagctgtgcttttagaaaattcttgagacacacctgttcggccaggttgcatagtgaacctgcagcaggggtggggcctccccagggacattttggccaagctggcatcagctgccccaggcttacaggctgagtgtcacactcacctcctccctactggagtcaactgcctagccctgtgggtgtttgagttcgtgacctcgatggaagatagaaagcagcaggaaagacagtccctgttatcaaggcattgtaacctaaggtcatggagactcgtgcttatgaggtatatgtgggttttaagtgtgtgggaaaccttcacagggcagctaactgcagacctcccaaacccctcctcctcctctgccccagctcagggtgggcttctgggccgggtcctgctggcctcctatcacagcgaggttggaatctgtactgtggagactgtggcatttctgcatcattcctgatgcccgatgctgagattaggaaatcggtctctgaggctgagaggcagtttctcagagtatgagctgggacctgaaaggccgctgttggaaagacagcagcagcctgcaggcctttgtgagaactgtctctatgggcccccgagactgctgtgcgcctgatgcaacaatcacttgttgacaggaggtgtcttcagtcccggccgtggttcggaggagaccacgataaactccttcaggatactgctccatcattttcctcacccgaagataagagccagctacagacgggtgtgttgggtgtgacgcaggctggaaatgtgcagaagtggttcatttttcttccccttaactcccatgtccctgtggtaaaattccattgctgtaaagtcatgagctcgaaacccagttatgctcagctaagttccacggaataatttcattcaagatcataaaacgtaaaacatcacaaacaaaaagtgtctctttacaaatgctcacggtatgacgggcagccctccaggagtggcgtggaggccggggcactcagtcacgtgtgtgccgggagcacaggccttcctcgccgtgcgcggctcctgagctctgagtgaggcagacggtggcagtgacccatccttttctggtaacttcttaggggcaaagaataaaaccattcttcagtttgccccattttatgcctttaatttcaaaaagcatttgacagacgcagaaaagcgcatccctgagcagccctgcgcggtggctgagtgcctgcgtccagggagttgagtataaagatcttcttccttcgtgataatttctatgcctgcatgtcttaccatgcctgattatagcaaatcccaggtacacgttataacaacagctattacgttgtaaaccgaaaacaaaattctaagcccccaaccaacggaatggacctgcatcttggccaaggggaccccaaggaaatgggaaaggcgagttcaggctctgatgggaagaggggctcggacaggcctcatcccaccctcctccctttggaccagcagtgacattaaaacagagacctgagactgacaaaacagactctctgtaccagtaagtttccaacctgactctagtgtaccctcacatgaccgatagcaggccctgagagaaattatcttacctcaaaatacatttcattgacatattttgaaatggcccctcacagctgtctcttgtgggggaaatttgcattctgtagagaatccacttccctttccagctcttttctggagggtctgaacccttttaggctctgctaagagacactcaccatctcttctctctgaagcctgctacctggaggcatcctctacatggaggaaccttggcttccacgacctccttatcttaacttcacgctgacttcaactcttcgtgccgagcttcactctttcaagcagtcgccagtcaggaaatctttgaatccacctgtgacctggaggctcccccaccccctgcttggagatgttgcaccttcccaggccaaaccaacgccaccttccatgtgttggtttatgtctttgcctgtcacttctgtctccctaaaatgtgtcaaatcaagctgtgccccaaccgccttgggcacacgttctcaggacctcctggggccatgtcacaggccatggttttaactttggcaaaataaacccctaaattgattgagagccatttcagatactttttgatataaacgtaagttgtggaaagagatgacatgttttgtttggagtgttaccaggagttgttaggatcttggaaagtcacagcttgcagtagccctgtttggccgtagcccccataaaagcaggagtatctgtgtggggtgatggaaccctgaccctaggcgtcctggcacggtggtgcctctgcattcacggtgacatcgctcctggacacttcgcctctgacacctgcggggccccggcctgttccttataggctcatgcttgagtgtttatcacgacttagcttccttgtgtctgtcacagacagtgcactgtagtggtttgtagaagttcctggtgcaggtagccctgttccttacgatttcatggaatggggacattaggaatatttgtttcctgatggaggggttcctgggtctgtcagggttagaagacctcctgatgatgagcagaacagggcagggagaactctgtctggaaggtccaggcctgggctgggcccccaccctgcctcccatccagacagagtcccaggtggggcctgtgggctgtgactgctgcagggatggcattaaaggagccgaagaggacctggaagcccaggaagctggtgacgtgccccctgcatcaggctgtgcattaagtcaccgcattcaaagggtttgtgtccccttgatgggctcgtctgcctggggctggggctgcagtgggctggaagtgcagagtcctgcgttcacactggatggctactgaggtgaatgggacccaggcacgttttcttatggaatgtccacagcctggttgtttatcccagaagatcagtaatagtgacaccctctgaccatgagccaacctctttccttagctcagggcgctaccagtctgggctggtagaagccccgacacttgcctcactcggatccctggaggaggattatatgggcactggggcaaggcagggacatcttggcagcctccccaccgcacgcttttcttgcaagtcctttgaacggcacctgctccttagctgctgcctggcaactttgagggtttcagtgagatggggtgagtgcttcccagccagcaaagtgcgttgacagtggctggcttgccccccctcccccccgccccggctctggaagcttctccccctgggtcttccagtctcatgtctggacacagacaggagaggtgaggaggagcagcaggggtggcccgggcagttcctgtgacctggaggcctggcaagttgttctgacggccaggcccatccttggggaggcctctgaggacgcctggaaccccaggcccgccctgccttgttttctggtcctggcctgggggggtcgtggtctcgctggtgcagcctcctccgggcaggccccgcctctgctcccttcccctcactccatctgattcggccccgtttccttgtccactccacgttcttctgagcgtgtctctgggacatggttaaggttaagaagcggcctctgaacgagggagaatgtactgaaattgcctaagtgaacttcaaacacaggaagaagcgctcagtcgatgttcatggtgagaacgagggttgatcttttgaatgagtcacgggtttgagagagacctaagaaccattcgatctgaaaactagattcactttgaacaaaatatctcaggtgctaaatactccagttagtgtggggaaatgtctctgagaacgaaagctctgactgaccggagcctgctacagtggatctgaaagatgctcacgaataattctcgctgcagagcttagtaaaccaacaatacaaacgattttctgtaacgacctcccgtaaagcagccactcccctcacagcgctgagcaggcgtaaccgccagggtcctcccccttctgaagccgcggcttccttgcaggccggtgtccggcgttgatcctttaactgaccatgggcagttttagttcacgagtgtggattcttgggatacggtcgggggcggatccccctgtcacgggttgtagaaattgacgcagcgttttccgatgtgcccacctgcttgaggaaggaatagtggtggagacggacttcttattcttcagatgtgcccacctgcttgaggaaggaacggtggtggagacggacttcttattcttccgacgaggcaatctctgcctctccatgcaaggtcgtccaacctgccttattttgttgtttttctgttttcttttgttttaggcttttagcagcctgaagccatggtttttcatttctgtctctagtaataagcagaagagggatgagtaaggggctttactggcccaaccagaaacaaaaagtaagaacccaaaactgtattctctcctttggacacctgtgctggggggagaagcccctcacccagaggctgtcacagggcattcctgggaccctctctttcccagactgtcctccctgcagagctgcgtccagaaggtgcgtcccggctgaatctatactgcagcctcaggtcagtgactggcccggcagtgtcttctggggtcagggtccttgcaggaccaccgtcacatgcttgcatccgtctccctgtaagggaaggggaagggggagggtttccctcattggcttctgcccaccccccaggatgggggcagaagcacctgagggagtctgcctcttccctccatattcactgtgctgaaagctgcagcaggtgcccagttctgcaggaaacaggctttgaacatggattcctgtgaggaggatgtgggggcgttgggggccactgtgggaaggtggggagatgtgggggtgttgggggcccctgtgggaaggtggggagggtgtgggagtgctgggagcccctgtggaaaggtggggagatgtgggggtgttgggggcccctgtgggaaggtggggagggtgtgggagtgctgggagcccccgtggaaaggtggggaggatgtaggggtgttgggggccactgtgggaaggtggggaggatgtgggggcgttgggggcccctgtgggaaggtggggagatgtgggggtgttgggggcccctgtgggaaggtggggagggtgtgggagtgctgggagcccccgtggaaaggtggggaggatgtaggggtatcgggggcccctgtaggaaggtagggaggatgtgggggtgttgggggcccctgtgggaaggtggggagatgtgggggtgttgggggcccctgtgggaaggtggggagatgtgggggtgttgggggcccctgtgggaaggtggggaggatgtgggggcgttgggggcccctgtgggaaggtggggaggatgtgggggcgttgggggcccctgtgggaaggtggggaggatgtgggggcgttgggggcccctgtgggaaggtggggagatgtgggggtgttgggggcccctgtgggaaggtggggagggtgtgggagtgctgggagcccccgtggaaaggtggggaggatgtaggggtatcgggggcccctgtgggaaggtagggaggatgtgggggtgctgttgggagcctggctatttgcctaaccacagaatatctgtgactgtctgatcatctgcacataattggcttttgaaaggggtgtgtgactcttttactctgaagagaggacattcttctgatacccagtctcacaataaaaagttgctacctttactttccccacttggccaatgatatcagtagccacactgcaaactctgaagtctctcagagctctagtctaggactccagagcgtgagtgcgtctgtggtggtgggcttgacctgaggctcatccttgtcacctgctcggtggcagtgcctgcgtgcagacccctcgcagcactcaggtgtggcccgtggacttgtggtttcgctgctggctggggaaccccctccggctcctcacttccccaccaagcgctggtcacagaaacgcccttctctggtcactgctctctggcctggcttggtggtggctttggtggcagccccgtcacccctgggatccgtgtcctcctgtttctttcgtttctcctgaaggttttccaagtgcctgtttgcttctgggaatttcctctctgccttcctccgacttcctcatagccgttcttttattccggcctcccaagattgcgtggagcccggccactgccagggcggccctgtgatgagctacatgggacacaagaggcagccccaggcgcccgcctccacctctaccagcagcgtcttcgctttcacttctgccttctgcggcgtcttcctctgtggagttggcgtcggccactggctgtggggcaacctcagcctctccagcggacgctgcaccatccctatggtggagtctcagctttggggatccagggtgcctgccggatttcagacagcgcattcacagactgtcgccagctgagccgccctggtgtctggagttgttctgtgtatgctgttatccagttactgactcgcagtcctgcagttgtcttcattagatatatattcaatattttggaaatatgcctacaatgcattcgttgtctcggccagtggctcgtgaccctctgcacttggaaggtatataatttccgttgcttaaaaggcgacacgtatactaacatgtttgtttgtgaattgggatatgcttgcttagttttctggctaattcatctttagaaggagggactcagtcgtggggaataaacgcagcgacccctcggtgttcccgctgggctcgtgggtgacgcagtgttttccggtggcttgggaagaatctggaggtcgggtgctgaggcttgagcgtctctcctgtaggttggtttcgcccggtcctcagggcggagttgctgctcattctcatgctgggcctgttttccgattcctggtgctctcttgtcttcacctgcagttcacttgcgggcagtggaggctgcactgtgacgttagtaactgtgaaggtgtgacccatggtggaaagttggttatgtctgtgattgatggggaggtgtttgtggtcgggggtggaactgctatggggggaaggtttgcaagtcgggagacgggagcaatgacagggccccatgggctgccccccggctcctccttccaggctcctacccttccccatgcccggcctcccccacttgcctttctcttcttgagtcagcaccactactcacacccctgagcgtgtgccagggctgagctccaaaccgggcacaggacctcccggccccacggcgtgcctgcagccccgccctcctctctgaggctcagaggcacagcaggtgcagcacagccttggccctgaggctcccagcatggttgtcccggccagtggcttgtgactctctgcccgctgcgtttgggggtgaactgaaggagcccgtgacccgggtccctggcagctgtggcctctttgctgcgcttcctctttggccagagccaaaaccaggttctcttctgcacactggagcagggaccttggcctcaaattctaatgcctgagtttatagttctcccaacttccccagagccggcccatagctcagtcatgtgaacctcgacaccaccctggttttccaggtgagatgagcctcagtgacaggcagaaacacgtggccatgaggaatgcaccagcctgagtctaagggaaagctgccgatttctagcactgatttgcagaggggtgggcgagcctgcccagtgccctgtggtgaagaggagtctctgtcctgagagaggcaccgtgaaggcaccgtgctgaggccagcctcagagccgcggggaagccaggtctgtctgatcgcttcccagcacttcccgtgccatcccacgcggctgtaaatggacacacgttagccacagctgctgcttcacaggcagcctggtcagaaacgtactcctgtcgaaaatggagggtgaatcgcatgaaatcagcgttacgtttgctcctgctgcatttcatgagtccagcggagtctgttccaactgcaccccccaatcctggacgtgctgtgggctccaagcgatgctttggtcaccggctcttttcctctgtgtctcgactcttaggaagctctgtgtttcttcccactgttgtgaactatcagaattaggcattccagagtaggccaagaatgatttggggtgagaatttatatttttatttcagttctggacccagtaaactatggtctaggtccgctggcaccccacatttcccaggtcgactgtgtttccagatcaaagggatgtccctgtgcttttgtggatcattgtgacccaagtgattttgtgcaaaaaatatcttcatggcaggagaatgccactgagagccttgaaaatacctgagatttgtttgaggaagaaaagaaaaaaggaaggagagaaatccagtcgttaccatgagtgtgacgagagtggggagaaccagtggagcttctgatcctgtcccagcagatgccagtggctcggaccaaggaggacagagggatgggcgtgcccacgtgaagcctcaccccagaccccagaccctgcttacatgccgggacgaaggtgggagagaaccgtgcatctcagcacggcggtggaaacgtggtccacctgcggagggcctgtttgcgtttattacacccgagcaaggcccgcacgcccaccagaggggccagggtgcccctgggagccactgagagacgggggaggcacaggctccacgcgccgcttccctggactgctaggaggcggcgatggcgagtcaggaggaagcctatttttagaaacgcttaagtgcccacgatcttctgaccatcaaacaagaaacgttgctgtttgaagctatacacggacggcagaacaagaagtggctgtgtcactggatacctgtacatttgaataccggccattagggagaatcgccctgtaaacattgatccagtgattgaggccggtcggcttgcttctgttctgccccgcggtgtaattcagctaataggttttgtttgtctcagctgaaatgtgaaacttccattaggtgtctaaccctggctaaaagtggttttcagcctatttttaaaaaatctcctttgtccctgcatgcattctaaccccattctaacctgatgcgggcagccacaacccaggccctaacagagttcatggtaaggatggtgaaggcgtgacccacggtggaaagttggttattttgggtaatccagcgattttctgattgaacttcgaatgcggaaacatcttgcccttactggggcaacgaggggaggcaaggcgtgcgccaggcagagacaccttggaatcccacccagcccagatgtgtctcctgggttctgggacgggcgcaggtgactgtatttgcgctggtgggaggagttgcccccttggttaaatccggaggacacagctgcatggtgcttgccctcagccgtttctctcttcttactttgagaataatctcttttttttctagtttctcttttcttaggcatactcctttggaaacttactgggctcacttttacccactatgagaccctatctgtcatgagtagtgcaaggttagagataaccaggtccacatgcacttgtgtctttctgtagtgtgaggcctttgttgacgttatttcagtcacaaaagccgggaactgctggtgcttcccgtcactcgggtagtcccagccgcgggcacacaggctcaagccactcctcacatcagtcaatgttgtaaaccatagtaatagtatacctaatcaatacataaatgttataaacactccacaacaaacaaagtaacatttaatatcaagagaaaaagggagataggaggaaacgttaatgaaccagtccggtggggagtgaagcagacaccgggagccctgggctgggcggggtggtccgtggtcttacgaggaggactcaggtggcagagcctgcggggcagatgccaagttcttatcacaagtgactgcgaggcggcagcggctgaggcagagtcctcccatgagaactgagtgctttttgtgtccttacctggttggatactgtcctattttttttaatttgtttattaagcaaatcaccttatctttgttggcaaagtgccctatgaaatgtaaaacaaagtctttttctaagacggagtttattatgtcaacagtgctctatatactatatataaaaactaaactttaaaaatgttgctgacacgaaaattgagagaagcctacgtttgtgcagaagatgggcaggtagaaggttccagcggtgaggggtgctgacctggagcggctgcggtggggccatgtggctggaagcagggcagtgagcagtgctcagcctgtcgcgagtgtgtaggaagagagctttgttgaaatataacttacatatcataaaatcacccacttaaacaatttgatgagttttattatatttaccaagctacacaacatcaccacaatctaattttaaaacattttcatcaccctcaaatgaaaccccatgcccagtaccaggccctcccaagtgcttgtcatcaccctcaaatgaaaccccgtgcccagtaccaggtgctcccaagccctgtccccagctcccctcccgtcatgccccagcccagccctgggcagctgctaatgcaccttctgttgcccgcagatttgcccgtgtggacgcttctcgtggatggagtcaagcagcctggggctttgtgactggctctgccacttggcggggtcaccccgcatttccctggtgactaagggtgctctgcgtcctctcctgggcttgttggccatttgcaggtctctagagaaattccgccttgtcttttctatttttgagtttgaatcattctgtatatattccaggtacaatctctaattgtttatgattggcatctgatcacggatgctccatgtagggaatggctctgccatgaaagcccaagaaccctgagtgtgtccacgtgggccatacagggaaggcctggtccatggtgatctctgtctgggagggactcaggagcctcccagagccccgagggctgtggcctgtgaggtgctcccttgtgccatggcccatccatctctctccccagagggtgccatgaggctgtttctcatcgcctctgggttctgatgagctgtggcgcctcctgccctgccctgccctgccctgccccaccatcgccaccctcagaacagaatgcaggctgtaaaccgcttagtggtggcctggattggcctgcagcagtttgcgtggtgtcaccctgcccttctgttttcatgtattttaatttatttgctgcttaatctgagcaaaggaaatgccgcctctctctgtatcgaccaaacccaccatggctttctcttcccacgggtgagtcttgctttcccgagctgtacgggtcccaagccgatgccaggcattcagccagtggccaggagtccttccccactctccctgccctctgaaagagcaaatgaagggaatccttgaacctctgggaagctgtagcccttttgtaaatgtgcagccctgtggcggatgggggtcccaggaaaggcccagggctttgtctgcagaaacagctttttcctgtgctcttttgggtaactggtccttcctcaacactgttgatagcagctgtggcgctgggctccatgcagcctgcagcagaacagggtgtttttagtcgtggtgccctctgtgtggcacctgccaacgccccgcgtgtgtgagtggcgatctgcgtctgtgggtgacgcgcatcacggggtgtggagaggtgcacctgtgcgggatttccacgccacctccaccctccaccctccaccctccaccccacctcgtgccttcccagggaagtcctgcctgtgcctctgctgccttgggaagagaaggggtcccggaggaactcacagagcggtggaaggcatcaaagaacctcagctcctcaaacacagtgcccgctgcctccctgcttcccgtccacctcacggggaactaggaattccctcctgtgtctggcggagagagaacctggctaagcattgcggccgaaggttgcagcctcctaggaaatgtccaatacaaaggatagactgcaggctattttgattttactcattttttaacagaacttttatgaaagcagattttacttgggtctggtgccaggatttgtctttacttgtcacatcagctgatgcctcccaggtttcgtaagtcatctgttctaaactggaagccaggtgtcttacatcaaagcttccggtatctccagttgcagaaattagaagagggtggttgaggaccatgtcttcctgggtgacgcccttgagaagatgtcacacctgggccctgtttattatatttggagaaatgggagacgatgatactttagaggaacacagatcccattccagcaactattttaatcagggactctcaggggagggtgagattccaacttacaaattgcaaatgtgcgatgtgctgcacccactcacaaaagacgtgtaccagatcacagttgcggctcatttcaaggtaaagcagccctgaaagacatgcagaaccagagcggttgcaagacccagactgagcagacaggggaggcttcgccttcctgtgtttgcatgcacagcccggactgcatggtgacttacagtgtatttctcatcccaggtcacagtctcagagtgtgagagccctgggtctctgggtcaggtctgaatgaacgctctttcctatgggccttttcctgtcactgccctgtgtatgtcagactggctaagcaacacacatgtctaccggcatcggtgaagagcgtcgttggcgtgcgaggctgtgtgtctgagcagctcctcccaccttcccccgtcacgggagccgcagagttgcaagaccctggggaatggaggctttgttgttcggtgggtcccacttcatcggggtaggcggcaaggccagcgggctgcagcgtgtgcctcggatgtggcgtctgagggacagcgagtgggttgcccgcaggggccttgcttgcactggcttagagagctaacagcgtttggtgggactcagtttatcgttctttccctgctttgaggcaggcccttgatgtgcaggtgaagtgcccgtgggctggccgcgtagcttccaggtgtttcttcttccagtggggttggcagaacacggcgtgaagctctgctgtgaagatgccgaaaacagcgcccctctctgctgaagggctcgttatccgactctgccttagccccgtcctcttccttcctaccacacagcgggaggcatgggatgcacacaggcgggcttccacagtcggggggccgctgacaggaggaacccctcccagcagcttcagggtgcttttggcccagcagcctggggcctccaggacatgcctcctctaaaggggtgttaggtaactgcagttttctcctctcctacttaccgttgccagagtttttaaaaagaaggaggcgaatactttcaaatgacttatataaaaatctatattttaaatttatttctgtaagaaaaaaattggttggtacaaatatagcaaaaatgttaacatttgtgagatctgggtgatttatttccttactccagttttctgcacgtttgaattatttcataatgccccccccgcctgtaagtgggtgtatctggagaggtgtcatccttcctgaagagggacagtggctgagccacttgtgaccagggaagcccagcccacacctccacggccctggcgcagggcgggcgcgacttagttcacgacaacctagtttctgcccccagttccaacttggggtcagccagagaacagcaagtacgcccccgtccccttctccccttgccagccccacaggctgctgcgcctcccgggcgtgagcccacgccgtcaggcccacagctgccctcccagccctcttccccggaccccttcccgcctccctggcccggctggagtccctgggagcccgtggaggcggctgacctgcaggctcggagtccgtggctgctgctgcttgttccagtggctgtcgtttgtttccacggggattcatgttgacatctgttactcgtcctcaagtgagcccgtctgcatgaaggcacaccttggggctgctgagtcagccacatccttgacagttccccacagcccctgtagtgtgtcctgtgtgtgagcaaaagcgcaggccagatcccagaccctccttccatccccggactgggcgcattggagcaaattcctccatgctgcctgctccgtcctctcccttgccctgttcctttccatgctttattaacggggaaatgtggggagggtcagagggccagtgaggccagtgctgcccctcaaaaggcaggtgtctatgctgcgtgacactgaacgctgcctaaaccatctggataattgatcgggtgtgagtttgcacgctgtgctccggcctgcctggcgatggttctgggtttggtgttgcgctctgtcaagtaggaagtgatagtaaattctattttatttatttatttttttgagacagagtctcaatctgtcgtccaggctgaaatgcagtggcactgtcctggctcactgcaacctccacctcccaggttcaagccatcctccttgcctcagccccccaagtagctgggactacaggcatgtgccaccactcctgcctaatttttgtatttttagtagagacgaggtttcgccatattggccaggctggtttcaaactcctgacctcaggtgatccacccaccttggcctcccagagtgctgggattacaggcttgagcccccgcgaccagccgagatgacctgtcgggtgagaggcttcagctcctggcctgagattaatatctgaccaaatgctgtggtgcacactgagagtgtcgcatcgtagatcttctgaaacgcagcgtcttgccccttgagcctctctgcaccgcgggtttggagttcatgctcctgtggcagtggcctcaggggtgtttgctccttagggaaattttcctcgaccactgaacacaggtcctgggcacctgtcagaaagccacactgccaggcaccaccaagctcaggcgctggcacctgtcagaaagccacactgccaggcatgtgcacaaagactgtgtgttttcaggcagcagtggatcaatcccaaatgtcaaaactatctttaaaaaaataactaaggctgggcatggtggctcacgcccgtaatcccagcactttggaatgctgaggcgggcaaatcacctgaggtcaggagtttgagaccagcctggccaacacggtgaaacccagtctctactaaaaatacaaaaattagccaagtgtggtggcatacacctgtaatcccagctacttgggaggctgaggcaggagaatggcttgaacccgggaggcgaaggttgcagtgtgccgagatcacgccattgcactccagcctgggggacaagagcaagacttcgtctcaaaaaatatatataataacataataattaagggaaggagccacagaggctgcccaggtagctgcattgatgcaatttgtggtgacattttctctgaggctgctgtgctgtgcggttacagctgcccctctgcgaagccccctcccgctggaaggtgggtgggaaggctgccggaaggctgccaggatgctgtgcggtgccaggtcctgagcacacatatcaggagaagggatgtgagacttcctcccccgtgggctccatgcagccaggaagccctgccgctccctccccatgcgctccccacacgccgctcaccgtgcctttctcccccaacgccagatgtggaattcctctcggaggtgctcttatggcaccctgcacggagaggcctgggcctggccccgaagaaggcacagcccatgtgcaggcgcctctgtctggaaggcatgctgcgtccattttactgtttccccaaccctgtggcactccttcctgttccttcttctacagtcttccgtgtgaatcgtggaaatgagtcagatgggcatgtttaacatcataccacacataccttttgcaaaaatgtattttttagcggccaggtgagcagctgatgtggtggacagaaagctcaccggaggccccaaggccttgcagcctccacgtgcctctcatcagtgtgtgaggtgcagtaggcggaggtttgctgagcttagcggctctgtgagaggaggtcgtccaggtcagcggctttgaaagccccggcacactccagctcccatgcagttatgctgtgtaagaaatggcaacagggccaaaaccttgtaactctcttcagagttggacgtaaaacactgaggtagctagaaatacattctaagttgaggtaatttggggcatggtggcatgcctgcaatctcagtgctttgggaggctgcacagggagcattgcttgagcccaggagttcaaggctacggtgcactgtaactgtccctgtgaacagccgctggagtgagtagccactggaatgagtagccgctggtttgaggagtagccactggagtgagtagccgctggagtgaggagtagccgctggagtgaggagtagccactggagtgagtagccgctggagtgaggagtagccgctggagtgagtagccgctggagtgaggagtagccactggagtgaggagtagccgctggagtgagtagccgctggagtgaggagtagccgctggagtgagtagccgctggagtgaggagtagccgctggagtgagtagccgctggagtgaggagtagccactggagtgagtagccgctggagtgaggagtagccactggagtgagtagccgctggagtgagtagccgctggagtgaggagtagccgctggagtgagtagccgctggagtgaggagtagccgctggagtgaagagtagccactggagtgagtagccgctggagtgaggagtagccgctggagtgagtagccgctggagtgaggagtagcccctggagtgaggagtagccactggagtgagtagccactggagtgagtagccgctggagtgagtagccgctggagtgaggagtagccactggagtacgagtagccgctggagtgaggagtagccactggagtgagtagccgctggagtgaggagtagccactggagtagccgctggagtgaggagtagccgctggagtgaggagtagccactggggtgagtagccgctggagtgaggagtagccgctggagtgaggagtagccgctggagtgagtagccgctggagtgaggagtagccgctggagtgagtagccgctggagtgaggagtagccactggagtgtgtagccgctggagtgaggagtagccgctgtgcttcagctgggacagggcagcaataccccatctttaaaaaaagtaattaattattgtttaaaagtaaatagttttcacttcctcggagattttcaggaagagctttatatctaagtttctagaatttacacagaagactgaaacagagaagcacttctgacatctaggaatgacttttcctgccaggcgcagtggctcacgcctgtcatcccagcactttgggaggctgaggcgggcggatcacctgaggtcaggagttcgaggctagcctggccaacacaccatttctactaaaaatacaaaattagctggacgtggtggcgcttgcctgtaatcccacctactagggaggctgaggcgggagaattgcttaaacctggaagcggtggttgcagtgagccgagattttgccattgcactccagcctgggtgatgagagcaaaactctgtctcattaaaaagaaaaaaaaaaaagaatgacattttcctctaaggtagtaaagaaaatcacttgagtcattaaagcattaaaccaaaggcaagctgaaaatcagagcaagtttgatggtggtagttgtacagatgagtgatatctcttgatgccaaggtgactgttaggtttctagaatgagaaagtgtggaaataatgatctcgtgtgcaaaccatgcatgcctttcatttggcaaaaatacttacaacatttttactgaggtataattcacatactgtaaaatcctcccttttaaagcatgcaatccgttggttccaactggaaaatattcaaagtcgtgcacccaccaccaccctccaacccagaaggttttcatcccccagtcagaggcggtcggcagccaccaccgccctccaacccagaaggttttcacccccgggcaggggccatcagcagccatttgcccagcccccggcagcccccgtctctgcgttcgccttttctgggcatttcctcagaatggactcacaacatggtgttgcttcacacatgggatgctttctgtccccacgcgtgttgctgtgggtgtcggcgcttccttcctttccgtgtatcccttcatcagtggacgcgcgtttggaggctgccacctttgtcttccatgaacagcgcagccgtgaaccttctcgccgaattttttgtgcccctccaggagtcgctcgagatgtttcctttggtcggtttgtgtcctatggtcagtcacatcagcacagggtagatttttacttcagctggaacttgatgccagccctccaggggacttgccacgtggctttctcgatgcagtttggacaatgggttgttaatgagtcattaggaaacctgttacttgacatagacagtttggtgcctggtttcagctttgctttgctgatggaagcctctggccgtgggtgggttctgctgcgaggagttgcacagggctggctgagctgtgtggctgatcctgtctgggaacgcggagagagagaggctggggtctccatcctcctgccctggagagcttcccgactacccgtgtctttgctctgaatcctgaaaacagccccgtgtgatgtgaccccgtcttttgtttgtttgtttgttcgtttgtttgagacggagcctcggtctgtcatccaggctggagagcagaggcgccatcttgtcactgcaacctccacctccgggttcaagcgattctcctgcctcagcctcccaagtaggtaggactacaggcgcccacatgcccggctaatttttgtattttttttttcagtagagatggagtttcaccttgttagccaggctggtcttgaactcctggcctcaagcgctccgcctgccttcgcctcccaaagtgctgggattacagacatgagccaccatgcccggcagggaccccgttttgtctatgtccccgtttatgcacagtatgtctggccctggattcaagaccggtgaggttcagaagttacacgattgaggctcctgagtttgttttcgttgctaactgtacagagaaccagaatcctagggctgggaggaccacgaaggttgggcctcctaatcccttcatgtcgctgctgacaacatttgacggacgcgtggtgtgaggcagccgcagccacagagccagtgagcagcagggaccgggcgccctgtccccaggctgctgttagtgacggtgtctgcatcctctgggggtccagcgtgttttcggctctgttccttttgggcagtttagtcttcctagaatttgaccatgtgtgggctgctctgtctatggagtagctgttcttttattcatttgctttcttaataaacttgctttcactttgcaaaaaaaaaaaaaaaaaaagaatttgaacatttgtggagaatacaacacaaagagctccctttggtttgaagtgtgaacctgaagagacatgtatgtttccgaccttcctgatgccctgggtgaggccgtctaagtgacctcatggcttcaggtcctttcctgttccaatctggtgtctgttatgctgacgaggccatcaggcaaggccgcgcacttgccaggcaaggcccactgcatgttggcaggcagcctgttttctgaagccatggcacagacaagaatactcattcctacttgtgtcgggttaaacgccgctacactgttgggctgtatctgagttgtttttgatgtaattatttaatgataaacgtctgctcgccggtgttgagactttggagtgggcttcatccattcatcctgatcgttcctccatgagacagggtccctttgttgctggctggaagcggccgggaagcgtgggctcgctgtggcatgggcaatgccacacggctccagggaagcgttcagctttccaaaccagtgtctgggctcgtggccactcctgaaattcagttgccgtctttgaagcttcgaagaaagtttctaggattttcacttttgtattaaaagatatctgtatgcttttctctctttttctggttcacttatattcttattcagtgcaatttcctgatttcacgagaatgagaagcatctatttggctatgttctgtgaaaacaaaggagccagggactttgcttagcctttataggcagcagtttatttatgaagctcttaggatgcttttaaagtccacatccctgtggtttgttggcttcaccacaaaatagagacagcagggaaggcccccgtcaggcagggagacccagtcccggaggaggagggcccgtcctcgtggggaggggcagccaggctgtggcatggtcagggcagtggggctgtgctgcccacctggctttgagtccaggatgacggttactgcatggccagcaggctcgcggggaggccacgacccaaggtcgcgctgaggaaaactgcgtctggctcatttgagggtggagtgttcctccctggcctggtggctgccttgtacgtctgtccccaggagcatggaagcctcggctccccgtggaaacactggttgatagtctcagccaaacatctctgaaaacacagttggggcacatggagactgctgtggtctctttccgttattttacttagacttttctgcaaagctgagtcctaataaaagaaattgcaggtgaattaccgatggaatttattaaagcaaatgtgcagacattcacacagctcctgtccgggacgttctgggtgggacagtgtggaaagacttcctctgagaggttggtaggggagcagaggagctgatgacatcaagtccaaaaacagccccatgaggtttataaacaagagcaccacgcagacagggactccagactgttcagaccctgcctgccttttttggctttaaaaaacgagagttccctgaagcaccgaggggcagcccacacagagaggacttggccctgagcatttacaagtgtctgtgctgggccgggcccctggccttgttctgttcccgttgcctcatttcatgctccaggaccctgagaaagtgctggtgtccccctcatgggtgagaagctcagcgggaaactgtccccgtgcctgcggcgaggagtggcccagcagccaagggtcagcccttcgacggcagtgcccgctcgtccttcccgtcccactgcaccagcattcccctcatggaggaggcttccgtctcctcttcagctgtgtttctcatgccccagaaaggctgatgtcttgcagttcctacagagaactggggcgtgggacgagagccacacgctaaggccccgtattccgaggtgggctcagggccatggccagggctgcgtattcagatgtggcgtttggatttcccgttacgagctaaagtatttttgtggttttagtgctgacatcaaatggcccgcctgagtgttgttgaaatatttcttgtcagagctgtttccttaactcctccaaatacagtgttccgagtaatacagagatggtcaggcccaagtcagctttgcaggagagccttcctgttcctgagcagacacctagcagggttgagcgactcttacccatctgcagatgcagggccggtgaccccacagtggggcaagagcctggagagctcttggctttgcccaggaaggaattcaagggcaagcaggaggcggaagaaacagcttcattgaagaggctacagctccctgactgcccctgcagagcggggctgccctgttaggcggagaggagtagctcagggcagatttaattgcatgcagattaaggggtggtttatgcagaaatttctaggagaaggatgtaacttgtaggcgatcgggtcattgccatggaaaggggccgcagctcctggctgttgccatggcaatggtaaactgatattcacaccgcgggcatgtcttatggaaagctgcctctgccccagccctgttttcaccagtcctcaatctggtccggtgtccaagccccacctctggagtcaagtcccgccttctaccccagtatcatagtttttctttcctcttccattaaagacctttcccaacatcactgtctcttctgttttggaagccttacgatttggccacacgttctgttctttttttttttttttgagacagagtctcgctctgtcccccaggctggagtgcagtggtgctatctcggtcactgcaagctccacctcccgggttcacgccattctcctgcctcagcctcctgagtagctgggactacaggcgcccaccaccacacccggctaattttttgtattttttagtagagacggggtttcaccgtgttagccaggatggtctccatctcctgacctcgtgatccgcccatctcggcctcccaaagtgctgggattacaggcgtgagccgccgcgcccggccgcgttctgttcttatgtacacgccctgagctgtttccactggcagtcagctttgaagttcactgtgtggctctcacaggagcgcagaccctcctggtgctcaccagaagaccttggcccatgagggctgcgtaagacagggtggctcgggcctggggtgctgggccccaggtctccctgcagccctgaacgatgctctcagcagcaggtacaggtctccgttccgacgaacgtgcctcaaggcaacactctgggcaagagcttttgatgcaggttctgaggcagctgcctaacaccgctctcctttccgcagtgtgcaggagaagagaattgggtggacagcaggaccatctacgtgggacacagggagccacctccgggcgcagaggcctacatcccacagagatacccagacaacaggatcgtctcgtccaaggtaacttggcttgggtctgagtgtccataatgtgtctaaaaagcagctgccggggggtgttagtgcttctcggtttcaaagagcggctctgctcctggccctgctgtcacagccaccagccacccccagcaagggcttcggatcaggacctcaccgagggcgctactctctccctctcggtgactgcccacaggaggctttccacctgcccagggctcacagcgcagtgtctccattctcgggtgaccgtgccacagaggcagtgcaggtctgaagtccaggatccaaaccctacccaggtcccacttctgaggcgcctggccacgtgcttgtcgtgggccaccctggccagagtctcagtgccagtaaggtagaaacgataccagccaccccggagaaagagccaacaaacgcaggctggacagcaaaacctggggggaaatctttgagcttgttcacgaggtgcagcccaggtaaagcgtaggaagcacaagcagagtgccgcggtctaaacgaagcgtgtttctctccatggactagagcgtggaagtgcacacacatttcccacgttcagagagtgacctggaaacaggtcttaagaacaaggtggaaatttagctgctgccattaaacatggggtaaactgtgctttccaggtaatgcggaacgcacgtgcctgcgttcagactccatttatcttcaccgtccttcaaaatggatgagctaaacccacgcacacgcgtggacgggctgcacatggggtaaactgtgctttccaggtaatgcggaacgcacgtgcctgcgttcagactccatttatcctcaccgtccttcaaaatggatgagctaaacccacgcacacgcgtggacgggctgcacatggggtaaactgtgctttccaggtaatgcggaacacacgtgcctgcattcatactccatttatcttcaccgtccttcaaaatggatgagctaaacccacgcacacgcgtggacgggctgcacatggggtaaactgtgctttccaggtaatgcggaacgcacgtgcctgcgttcagactccgtttatcttcaccgtccttcaaaatggatgagctaaacccacgcacacgcgtggacgggctgcacatggggtaaactgtgctttccaggtaatgcggaacgcacgtgcctgcgttcagactccgtttatcttcaccgtccttcaaaatggatgagctaaacccaggcacacgcgtggacgggctgcacatggggtaaactgtgctttccaggtaatgcggaacgcacgtgcctgcattcagactccgtttatcttcaccgtccttcaaaatggatgagctaaacccaggcacacgcgtggacgggctgcacatggggtaaactgtgctttccaggtaatgcggaacgcacgtgcctgcattcagactccatttatcttcaccgtccttcaaaatggatgagctaaacccacgcacacgcgtggacgggctgcacatggggatgcctgtggcggcccaccattcacacgtgtgccctcacctgtagacgcatttaatttacattgggtgtcctgccgtgtaaacttctgtggagacctacttaattcacaccaagtgtcctgatgtgtagacccctgcgatagacctacttaattcacaccggtgtcctgacgtgtagacccctgtggagacctacttaattcacaccgggtgtcctgatgcgtagacccctgtggagacctacttaatccacaccgggtgtcctgatgcgtagacccctgtggatacctacttaattcacaccgggtgtcctgatgcgtagacccctgtggagacctacttaattcacaccggtgtcctgacgtgtagacccctgtggagacctacttaattcacaccgggtgtcctgatgcgtagacccctgtggagacctacttaattcacaccaagtgtcctgatgtgtagacccctgtggatacctacttaattcacaccgggtgtcctgatgcgtagactcctgtggatacctacttaattcacaccgggtgtcctgatgtgtagacccctgtggagacctacttaattgacaccgggtgtcctgatgcgtagactcctgtggagacctacttaatccacaccagtgtcctaatgtgtagacccctgtggagacctacttaattcacaccgggtgtcctgatgtgtagacccctgtggatacctacttaattcacaccgggtgtcctgatgcgtagactcctgtggatacctacttaattcacaccgggtgtcctgatgtgtagacccctgtggagacctacttaattgacaccgggtgtcctgatgcgtagacccctgtggagacctacttaattcacaccaagtgtcctgatgtgtagacccctgtggatacctacttaattcacaccgggtgtcctgatgcgtagactcctgtggagacctacttaatccacaccgggtgtcctgatgtgtagacccctgtggagacctacttaattcacaccggtgtcctgacgtgtaaacccctgtggagacctacttaattcacaccggtgtcctaattcacaccggtgtcctgatgtatagacccttgtggagacctacttaattcacaccagtgtcctcatgtgtagacccttgcggagacctacttaattcacactgggtgtcctgatgcgtagactcctgtggagacctacttaattcacaccggatgtcctgatgtgtagacccctgtggagacctacttaattcacaccaagtgtcctgatgtgtagacccctgtggatacctacttaattcacaccgggtgtcctgatgtgtagacccctgtgtagacctacttaatccacaccgggtgtcctgatgtgtagacccctgtggagacctacttaattcacaccaagtgtcctgatgtgtagactcctgtggagacctacttaattcacactgggtgtcctgacgtgtagactcctgtggagacctacttaattcacaccgggtattctgacatgtagacccctgtggagacctacttaattcacactggtgtcctgacgtgtagacccctgtggagacctacttaattcacaccggtgtcctaattcacaccggtgtcctgatgtatagacccttgcggagacctacttaattcacaccggtgtcctcatgtgtagacccttgcggagacctacttaattcacaccgggtgtcctgatgcgtagactcctgtggatacctacttaattcacaccggtgtcctgatgcgtagactcctgtggagacctacttaattcacacctgtgtcctgatgtgtagacccctgcggagacctacttaattcacaccgggtattctgacatgtagactcctgtggagacctatttaattcacaccgggtgtcctgatgtgtagacccctgtggagacctacttaattcgcacctggcatcctgacgtgtagactcctatgtagacctatttaattcacaccgggtgtcctggcgtgtaaacccctgtgtagatctacttaattcacacccagcatcctgacctgtagacccctgtggcgacctacttaattcacacccggcatcctgacgtgtagactcctatgtagacctatttaattcacaccaggagtcctgatatgtagatccctgtggagacctacttaattcacacctggcatcttgacgtgtagactcctatgtagacatacttaattcacattgagcatcctgacatgtagacccctgtgtagacctacttcatttacaccaggtgtcctgatgtgtagacccctgtgtagacctacttaattcacaccgggtgtcctgatgtatagacccttgtggtagacctacttaattcacaccgagtgtcctgatgtgtagactcctgtggagacctacttaattcacaccaggtgtcctgatgtgtagacccctgtggatacctacttaatccacaccgggtgtcctgatgcgtagactcctgtggagacctccttaatccacaccaggtgtcctgatgtgtagacctctgtggagacctacttaattcacaccgagtgtcctgacgtgtagacccctgtggagacctacttaattcacaccggtgttctgacatgtagacccctgtggagacctacttaattcacaccggtatcctgacatatagacccttgcggagacctacttaattcacaccagtgtcctgatgtgtagacccttgcggagacctacttaattcacaccgggtgtcctgatgcgtagactcctgtggatacctacttaattcacaccggtgtcctgacgcgtagacccctgtggagacctacttaattcacaccgggtattctgacatgtagacccctgtggagacctacttaattcacaccgggtattctgacgtgtagacccctgtggagacctacttaattcacaccgggtgtcctgatgtgtagacccctgtggagacctacttaattcacaccgggtgtcctgatgtgtagactcctgtggagacctacttaattcacaccgagtgtcctgacgtgtagtagacccctgtggagacctacttaattcacaccggtgtcctgatgtgtagacccctgtggagacctacttaattcacacctggcatcctgacgtgtggactcctatgtatacctatttaattcacaccgggtgtcctggcgtgtaaacccctgtgtagatctacttaattcacacccagcatcctgacctgtagacccctgtggcgacctacttaattcacacccggcatcctgacgtgtagactcctatgtagacctatttaattcacaccaggagtcctgatatgtagatccctgtggagacctacttaattcacacccggcatcctgatgtgtagactcctatgtagacctatttaattcacaccaggagtcctgatatgtagatccctgtggagacctacttaattcacacccggcatcttgacatgtagactcctatgtagacatacttaattcacattgagcatcctgacgtgtagacccctgtgtagacctacttaattcacaccgggtgtcctgccatgtagacttctgtgtagacctacttaattcacaccgggtgtcctgatgtgtagacccctgtggagacctgcttaattcacaccgggtattctgacatgtagactcctgtggagacctacttaattcacaccgggtgtcctgatgtgtagacccctgtggagacctgcttaattcacaccgggtattctgacatgtagactcctgtggagacctacttaattcacaccgggtgtcctgatgtgtagacccctgcgatagacctccttaatccacaccgggtgtcctgatgtgtagacccctgcgatagacctccttaatccacaccgggtgtcctgatgtgtagactcctgtggagacttacttaattcacactcaagcatcctggcatgtagacccctgtggttcttaattatttatgtgctcttgaagagttgcacatttttaaagaatattttacaacagaaaaggtcaccttttcaaagccttttttatgggattaatttgtaactacaggattgcaaaaaattttaatagctttaacctctagaaacaggatatgtaaatgctgaaaaacaaagtcccaaccagataagtcctgtgggtggtttcccagtcatgattcatggaaggagaaatgtactgatgagaaatcacatccaaaatattgtctctgcagtggtaatacttacaaagtcgacgcagtctcaggcggagctcactgaagatggtttccaagcttatatgtacttcacccatcccccaccctccagcccaaaacaaatcccaaacatactgcttagaactcagcctgcgcagcccagaggtacagagaggcaggaagcacccaggtgtccacatacggtgccattgtggacttgtagggcaggattccaggatatgggtgatgggcgtgtggaaccgcggcgccccctgcacagtgtggctcatttgagccggatgggggccgtgaaggcatcacccagcctgccccctgggagctggcttctcccttcctggggcggagctcgcccgacagccccacatgcctggttctccctgcagatgagggtgctgtgtggggtcacagggaagaaaccagcagcagcggcagagcttgatccaggcattggaggagggtcctggtacccctggcaggggctggcgggaagctgcacttctgtcattgcccatggcggctttggaggagatgacagagcatggcgaattctgcctcccactcctgacccctctgctgtgtcattcaagttttgtccttttcctactgtccgtttcgaacgtcactgcaggcagtggcctcggtggcttcgctccgcctggccctgctccctggctctgtgctaccctctctccccctcggctgggcccttcctctccgctgctccctgtggaactggagcccctcaaggtctcttcagtttctgatccggggagccctgcaggttgtcaggatgggttttgtgggcttattgctgctttccaggacctttgagaagccgtaagtctccttcctaccaggaagccctcactcaggaacgcacagaccggggtcaacaggctctcaggagcgccgtctgcgtgcaggtggagggtgtggcggggccaggagagcacttggccgcctttcatctcaacctctgaggacagaagggggctctcaaatccgcccatgcattgagatcttcgctcttcacagaggtgggattagtagcttagtctcagtttcaagtggatgaggttgtgtaatttcaagggaaaattacatccggcaatacctcttttgctaatggaactcaggaaggaaaggccctcagaaaggctggagtctggaatctaggcaggtagctggcctgacagtaaccttgatccaggtaaaccaaagtggaattctcgagcctggaattgatgactcataattgttttcatttaacagctcaggatgtgtgaaaaaaaaatgctgtttaatttgtaagacctaagtttacgactgattttggagaatacatttgtgataatgtatctatgttttcctggggtggcggaggaaatgatttctacctaaaaaaaagaaatgctagtagttaagactttttaagtgccacagaagcttgttctcagcaagtttgcttttatgaaatcaaaggatgaaagcctttgtcatggaagaagtcgtaatagaggatgaaaatgctgtcgggttatttttaacttctcatctgtttgacggaagtgcagttactggtgataggtgatgatagagtttgtttccttcttgggggagagactttgggcagtgtcaaaacctgaaatgacagcccagcacgccccgttccctgcttcctgtgctgtgcagagctcccccaggcctgcttgcaccccccacgtggggaatcctgaactccacaaagggatggatcactgcatgcctccttttccagatttgtactttggggcacagaattcacatggttcccagctttgcccacaggaggctacagaattaaatgttggcttagactatactgtccctccatgccttcaagaaagttgaatccttctggtaattggggagaaaaaattccctctgcaattcgtaggtatagccagtgttttcatgacttctatttgtataaatgatttccatgtttattatatcatgtaatctctaaaacaaccctgtgagcccaccaatactgattattaccaatgtatccatgaggaagctgaggcttagagctcagtcatgtgcctgaggccacagaagaggatagagcccctgtagtctggcactgggcttggacttccttccgcagagccaggggccctttcttttcatttttgagacagagtctctctctgtgcccaggctggagtgcaatggtgcgatcctggctcactgcaacctccaccgcccgggtttaagtgattctcctgcctcagcctcccaagtagctggaactacaggtgcccaccaccacacctagttaatttttatgtttttagcaaagatggggttttgccattgttggccaggctggtcttgtactcctgacctcaggtgattcacccgcctcggcctcccaaagtgctgggtttacagacgtgagtcgccgcgcccatccaggggcacgtttcttaacagcccctctgggtgctcacgaatttccggcatcagcaatccaccatcctggcataattttctgtgttttgcatccctgcctcccggtcataaacaaaagagtgacctcagttccatgcgagtggctgcttgtcccaagcagatgggtgtccggcgtccccgcctttttcaggactgtcaggtgggccctgtggtgctggagctgtgttcaggtgaacactagttgaggcttcagacagcttgtaggtgctcctgcgggcgcctgggctgctggcaggggacagtgcccgggttcgtctcgcagccagaggccagaggcaggccaggtgaggccatgctcttccctgtctgcacaccacactgctggcaagtaacacaaaacagagactggctaccccaaggggcaggaggcagcggaaacctgaggctcagacactagtgaggcgttccagctcagggccaaaatcagagccagggcagctgtggactctggctatggcgtctgtcgtacaagtgagaaacgaaaagaatgactgtcccgtgtcattcagcaaaacacatggtgtctttggaggtgaagagaggtgccaagcaccactcggttttcccagatttcctgtaggaggaaaaccacttggttctatgctgtggctttcacgccaggagctcctaggattgaggacgtctactgattgtatcacagtcgaagggcccagtgttacattacattgtgtccccaggcaaatacttacatttttacaattcaacaacgatgagcgaaggataactgtccaccattgtcagccttcccactctaacgtgtggaataaaatgctcatttcagttgattgtatcccgatggtactgctgtgtcagtgcagtcacgaccctttaaatgagttccctgggatttcacttttcttgttagacatcaccaggaattaataaccctccttttgacaatagtagtggtcagcagtaataacttactctgtgaaacatagagattacacagcatcatggggcttggctgcagccctcagtgcctgattagaataaagcaattgaggccaggcgcagtggctcacacctgtaatcccagaactttgggaggccgaagcgggcggatcacgaggtcaggagttctagacaagcctggccaacatggtgaaatcctgtctctaccaaaaaataaaaaattaactgcgtgtggtggcgggcgcctgtatttctagctactcgggaggttgaggcaggaaaatcgcttgaacccgggaggcagaggttgcagtgagccgagattgtgccaacgcactccagcctgggtgacagacagagtaagaccctgtctcaagaaaagaaaagaaaaaaagaataaagcaatcatgcaggtggtttcaaattccaaagctgtacagtaacattcaaatatggcaaggccctgccaggtgcggtggctcacgcctgtaattccagcactttgggaggctgaggcaggtggatcacctgaagtcaggagttcaagatcagcctgggcaacatggtgaaatcccgtctctattaaaaatacaaaaattagccgggcatcttggggggttgcctgtaatcccagctactcgggaggctgaggcacgagaatcgcttgaacctgggaggcagaggttgcagtgagccgagatggcgccactgcactccagcctgggcgacagagtgagacttcatctcaaaataaataaataaataagttatggcaagtccatgagtttgcacagccttccaggcctgatggaagtagatctgcatgtttggaaggattgcagatcatattttatctcataaatattaccagaacttcctcgtgtaacatgggaactttcaaaaccatagagaggagcattgtaaatctctgtggctcgtctccactgtcacagttcccagcttgtggccagcctgttgcatctgcaccttcactgtagttccaagggtcctttggaaggaatcctggacagcgtgtacttttcatctgaaagtacttcagtaaatgaaaggtggaattttaagtagactcttttttcattaatgtgactttgttactgagtgatgtattatagaaatttgtggaaacgtataattgtaataaatttgttggcttggatgctggaaagtaagactggcctcacatgggtgagctaaggtatttctttaatgtatccttttaaaagctaatggagagtaactgactttttcattgtggcccatttgagagaaaatatatctttctcaaatatttaaaaaggtcgatcacatgtgtaatgtttgccaagttgtatacacaagaaaactagaactcagaatcattaaataatttgctgaagtttacatggtttttaaatggcagggtcaggatcgaatatggggactgactctgaagtctatgtgtttcatagtatgctaaagagtaaatatttccagaatttcgatagagtacctaaattatcttgaggtggggttagcaaattgtgaattaagattgtggtttttgtaaaggaagaaagtgcctatacttttattggcaatctggtgtttttgtttgctttttttctgaatgagaaacaaaagaaatgaagagctagccatgtgttctctactctgtctcagtttgtatggctacttttccatccagagctcttgccttttggttctcaatttggttgcattcccatgaagaaaacctagtgtggcaggcagaaggatggcctcccacagatgtccacatcctgatccccagaacctctgactatgacactgtctgtggccagggaatcaagattgccaaacagctgacattaaaatagggaggtgattatagaactattcatgtggccaaaagtaaccacagaggcacttgtaagtggaagagggaggcagaacagactgtccgagctacgactggcttcagaggttgaaggggaccaaaggatgtaggcagcctctgcaggaagcaagaaaaggcaagaaaagtttctccctggagcctccaggaaggaaccagccctgctgatactttaattttaacccagtgaatcccattgcaaacttctgacctccagaacagtaaggtaataaatttgcattgttttaagtcacaaagtggaatttgttatagcagcataagaaactcatacacctgtcctaactactttggggatttataatacagactgtacggagattgacgcggtgtcaaaggacccgtgaccttgagacatgcccatagaatcatacacctgccctagccacatcggggatttgtaatacaggctgctcagagactgacgtggtgtgcaaaggacccgtgaccttgagacatgtccatagaaactttccaaactgaagagcaaagaggaaaaaagagtgaagaaacagaacagaactgtggacaactacaataggtgaagcaggccaggcacggtggtcacgcctgtaatcctggcgctttgggaggctaaggtgggcagatcacctgaggtcaggagtttgagacaagactggccaacatggtgaaaccccgtctgtactgaaaatacaaaaaataaaaattttttttaaaaaaattagccaggtgtggtggcaggtgcctgtaatcccagctacttgggaggctgaggcacaagaatcccttgaagctgggaggcagaggttgcagtgagccaagatagcaccactgcactccaccctgggcagccagagtgaaaactccatctcaaaaaaaaaaaaaaaaaaaaaggtaaaccatatatgcataatgaaaaaaacaaaagaagagagaagaaatatctccagtaaaagtggctatttccaaaattaatggcagatgccaaactaccgatccaggaagctcagagataaatacaaaagcagaataaattttttaaaaagggtacacctagacatatcacatttaaattgcagaaaattagactcagaaaaaatcttgaaagaagccacaggaaaagaacattttacctgctgagaaacaagggtaagaattatatcaaactttcttccagaaaccatctaaggaagaaaagaataatgtaaaatatttaaagtgttgaaagaaaaagccagcaacccagaattctgtatctcataaaattatccttcattcgtgaaggagaaataaagactttttcaggcaaacaaaaattgagcgaattcattgccagtagacctcccttgcaagaaatgttaaaagttcttcagaaagaaggaaaattatataggtcagaaattcaggtctacttaggaaagaagaacacagcactaaagtgtgagtttttgtgctgttacaacagaataccacagactgggtaatttatagagaagagacattgatttccccacagttctagagtctgggaagtccaagatcaagacactggcaggtttggtgtctggtgagggccccatctctgcttccaagatggctccttgagcactgcatcctctggagtgggggaaggctgtgtccttatgtggcagaaggcaaaagggcaaaggggcaaactccctctgccgagcccttttatacaggcacctaatcccattcatgagggaggagcccgcatggcggaatcagaactcttgaaggccccgcctcctgggaccgtgactagttgtcacattggcaacacctgaattttggaggggacacattcaaaccatagcaagaaggaataagtgaaggtagtaaaattaaatattttgcttttttgttgttttttatttcttttagagacgtgatctcaccatgttgcccagacgggtttagaacttctgggctcaagggatccactgcctcagcctcctgaagtgctaggattacagggcacagcacccagcttgcttttcgtgttcttaattggtctaacagagagtactttattcagaatgataatagcatttactcagtggtgattgctcaggggtgaatgaaatgtatgacagcagtgccctggggggcaagaaggaactgggcatgctgttgcgaggaatctgcgccacacacacagtgcgggttatgtgagagtgggcgtatattgtggcctctagtgcaaccactaagtaatttttttaaaaaataagtatagttgatattctaagacaggagagaaaatagtcacatcaaatgcttaattaaaacccaagatggcaggaaaagagtataagtcacaaaagaaacaaagactatgaagaaaggaataaaagtcagttacaaatatggtaaatattaatccagctatattaataatcactttaagtgtgaattgtctaaataaaccaaatacagaaactgtcagaatagaaaaaacaagacctaaccatatgttgtgtgcaggaaaggcactttaaatataaaaacacgggtttaagagatagaggaagatgtaccatgctgctactactcaaagggacacaagattagctatattaatttcagacaaagcagacttcagaacaagagaagttaccagggataaagaggggcattgccaaacaacaaagaggtcagttctccaagacaacataacaattctcaaagtctctgtaacaacagagggtcaaaatatgtgaggcaaaaacggatagaactggaaagagaaagaaaatccactgttatatttggacacttcatgacctctgtccacaggcagaaaatcagtaaggacacggttgaactgaacagcaccatcagtcccttggatctaatggacctttatgtctcacgcgtccatgtgaagagagtccaccaataggctttgtgtgagcaacaaggctgtttattcacttggatgcaagtgggctgagtccgagaaaggagtcagcaaagggagatggaggtggggcagttctataggatttgggtatgtagtggaaaattacagttaaaggtggttatcccttgtgggcaggggcgggggtcacaaggtgcagggtggggaggtcatgagactcattgtccaggggggaatgtcacaaggttgattgattagttggggtgaggcaggaacaaatcacaaaggtggaatgtcatcttttgtggttcttcagttgctccaggccatctgggtgtatatgtgcaggtcacaggcttagcttgggctcagaggcctcacaatttataaaatacttcattcaacaatagcagaccacacattcttctcaagttcacatggaacatttgccatgacagatcacattctgggccataaaatacaccttagcaccttttcaaagaatagaaatcataccaagtactctttcagaccacagtagaattaaactagaaataaataaataacaaagttaactggaaaatcccaaaatatttggagattaaacaaaacactactaaataacacatgaaccaaagaagtctcaagaggcataaaaatattttaagctaaacaaaaaatataacttatcaaatcttgtgggatgcaggaaaagcagtgcttagagggaaatttatagtattgactacatagattagaaaagaagaaagatccaaaatctacaagcttcaacattaggaaacttaacaaaaaattaataatcaacattagaacagaaattaatgaaattgaaaacaggaaatcagagaaaattttaaacatcaaaagctggttctttgaaaaaaaaaaatcaataaaatcaataaaactttagccaggctaaacaagaggaaaagaaaagagacacaaattccaaacatcagaaataaaggaggggcatcactactggtaacatggctaataaaaagattaaaaggaatatcatgaacagccctacacccataaacttggtaacttagataacattggccagtttcttgaaaaacgctatctaccaaaactcaaacaaggagaaatataatctgggtgggcctacatcaattaaaagaaatggaatccgtaattaatactcttccaaaacggaaagcacaagactcagatgttttcactggtgaattctaccaaacatttaaggaaaaaaaaaaaaatcaattctctacaatctcttccaggtaatagaagcggaaggaacattttctaattcgttctatgaggccagcattaccctaaaaccaaaaccagaaaaagatattaccagaaagacgatatcacacaccagtatttctcatgaacatagaagcaacgattctcaataaaatattagcaagtccaattcaacaatgtataaaaagaattatacaccatgaccaagtgggtttatcctaggtatgcaaggctgatccaacatttgaaaatcgactaatataacccatatttacaggctaaaaaagaaaacttacatgattatatcaataggtgcagaaaaagaatttgacaaaattcactacccactcatgtactgcagcaaactaaaaacagaggggaatttcctgagcttcataaagagcatctccgaaaagccctacagctgacgtcatacttaatggtgaaaaacgagatggtttcaccctaagattggaaaaaaggcaagaaatcccttatcactgttcttattcagcattgtactggaaatcctagctaatacagtaagagtagaaatgggaataaaaggcctacagctgacgtcatacttaatggtgaaaaacgagatgatttcaccctaagattggaaaaaaggcaagaaatcccttatcactgttcttattcagcattgtactggaaatcctagctaatacagtaagagtagaaatgggaataaaaggcctacagctgacgtcatacttaatggtgaaaaacgagatgatttcaccctaagattggaaaaaaggcaagaaatcccttatcactgttcttatgcagcattgtactggaaatcctagctaatacagtaagagtagaaatgggaataaaagtcctacagattgggaaggaaggaataagactatctttgttcacaagtgatatgattgtccatgcagaaaatcccaaagaaccaacaataacaaaaaaacttctggatgttagaggcgattatagcatggttgcaggatgcaaaaattaatcgctatcctatatgccagcaatgaacagttggaatttgaaattgaaaacaacactatttacatttaacccccccacccaccaaattacacaggtataaatctaacaagatatgtacaaggtctaggtaaggaaaacgacaaaactgtaacgaaatcaaagacttaaattaatggagagatgttccatgttcatggatgggaaaactccatgtttttaagatgtcagttcttcccactttgacctgtcctaatcaaattcccagcaagttaatttctagatatcaccaaactgattctgcatttatatggaaaggcaaaagacccagaatagcctcgcagtattgaaccaagttggagaactgacactagcccactttaggacttactgtaaaactacggtaatcaagacagtgtggtgttgctgaaagaatagagaaatagcggctgggcgtggcggctcacacctgtcatcccagcactttgggaggccgaggcgggcggatcacgaggtcaggagattgagaccaacctggccaacacgatgaaaccccatctctactaaaaatacaaaaaaaattagccgggcgtggtggtgggcgcctgtagtcccaattactcaggaggctgaggcaggagaatggcgcgaacccaggaggcagagcttgcggtgagccgagatcgcgccactgcactccagcctgggcaacagagcgagactccgtctcacaaaaaaaaaagaaaagaatagacaaatagatcaatgaaacatcatagagagcctgggagtagatccacccagtaaatccacccagatagtcaacccattcacccagatagtcaacccatctttgacaaaggagcaaaggcaattcagggcagacagaaaagcactatttcttttcaacaaatagtgctagaaaaactggacatgcaaaaaaaaaaaaaaaaaaaaacccagcaacagtgactctagacagtgatcacacaccgttcaagaaaattagctcaaagtgagtcatagacctaaatgtaaaatgtataataatgaaacttgtagaaatgtaggagaaagtctaggtgaccttgggtttggcaacaagtttttggataacaccaaaaacactgttcatgaaaggaaaattgataagttggacttcgtgaagattaaaaacttgagctttgcaaaatacagttaagagaattaaaatatgagccactgactgggagaatagatttgcaaaacacacatctgataaaaacctggtatcaaacaacacatggaaaataagggtgtttggatgggtagggcgggatgacctagggaggacatggaaagttagtttcttttttaaaactccagagactctcttctggagctccccttgccttttttattacagtcaacctgagatgggaactgaaaatatggccgtagttgtcatgaactggggggagccactactctgtttttaccctcattaaggaactttattgtgaaaggtaaaatcactttgtaaatgtgaattagaatagaaaatggaaattccttatatactctctaagccactggaaacttgaggcagagaagttttaaaagacgcacatggatttcctctgaaatatttgtaaacaccaaattcagaacatgttggttagtttaggaccataccaggctttagttgttacattgaattgtaaataacttatattcatgagcctggaattaaagaaattcttggtatgagaatttgacaactacttctggcttccaggagccagaacccaccttcgaatgggattttgaaataagccccgttgaagagacacacagatggcagaggccgcagcacaggctgtgagaccttcttcaggtttcggtagactgtcttcattacggcgtaaaaacatgtcagatgaaatttcagaaactatttccaaactcagtgaaggttcgtgacatctgggacgttgttgttttcaacacagaagttgaatgaaactgctacagaagcaaaatgagaagtgtggagaggagatgctgtggtggctgggcattctccctccttcccctccctcccctccttctctcattcccctccttccctccctgacctccttcccctccttctctcattcccctccttccctccttcctctccctcccctccctgccttacttcccctccctcccctccttcctctccttcccctcctcctccttcctctccttcccctccttttcctccttgcttcccttccttccctcattcccctccttccctccttcacctccctccccccatcccctctctgccctccttcccctccttttcctcctttcttcccttccttccctcattcccctcattcccctccttccctccttcacctccctccctgccatcccctctctgccctccttccctccttttcctccttccctccttcacctccctccccccatcccctctctgccctccttcccctccttttcctccttcacctccctccccccatcccctctctgccctccttccctccttcacctccctccctgccatcccctctctgccctccttcccctccttccctccttcacctccctccccccatcccctctctgccctccttccctccttcacctccctccccccatcccctctctgccctccttcccctccttttcctccttccctccttcacctccctccccccatcccctctctgccctcgttcccctccttccctccttcacctccctccccccatcccctctctgccctccttcccctccttttcctccttccctccttcacctccctcccccccatcccctctctgccctccttcccctccttttcctgtccttccccctgaggcctcaaagcccctgtgcctgagctgtggacaagaaacacgcctgcctcagaagctgcctggagctgggtgaaggcttccattcagctcgctgtcatgctctcactcagaggagagatcatgcagaaattactgaagtaaaatgctaatgtgttgagttaatgatcacaggtttacgttttataaaagacatcttaataatcaaactattgttgagctaccttgcgttttatcttgaattctctggagttaggtaatttacatacgtgtttcagagtacacactttgtttaagctgtcttagctgtcaacaaacactctaaattatgaattatgagttttatatctaaagctaaacattttgtactgtaaaatccagtgctacttactatgccctagagtaacactacaagagtaaaatctgatctcaatgatggatgtttgtttttcttttatgcagtacacattttggaactttatacccaagaatttatttgaacaattcagaagagtagccaacttttatttccttatcatatttctggtgcaggtaaggccggtcattgttttccatctcatcacatataaatctaaataagtgacattttattctcaggtaactgccacacggctaatgaaagagcaaggacatggtgcccctcacctatgattaatttatttattttcttaaggaagggcaaaatgtcttggttctgtgagatccacacaagctaaactacacacgacgctactttgggtttaagttggtgacagcctttcctgcccctttccttctagtaccagaggggaaatcagagctttgtcatcatttggacaagttcactgccaagctatgcatcgttacacttaatttactcttcctaagtgtgtgtggatgctctaaagaaaatccaggccgggcacagtggctcgcctgtaatcccagcactctgggaggatcacgaggtccagagatagggaccatcctggccagcatggctaaaccctgtctctactaaaaatacaaaaattagctgggtgtggtggtgcacacctgtagtcccagctacgcgggaggctgaggcaggagaatcacttgatcccaggagtgggaggttgcagtgagctgagatcgtgccactacactccagcctggcgacagagcgagactgtctcaaaaaaaaaaaaaaaaagagaaagaaaaagaaagaaagaaaatccaaagacagtacacatgaaaagagagtttaaaggaaagaaaaaaaagagtgaaaaaatatctcggggtatgagttagggagcaatgtgccaaatgtgttttaagaacagcactctaatttttctaaatcatacaaaatgctactgaaggactttaaaaatttttccaacattaaattattcaaatcatgtaattaaaatgtgacactgaggccgtggggtgaattaatacaaggcgtgccccgacttcagactgggtctgccactctcggtggtttccttgagcatgttccttaatttaaaaaaggtgccctcattttaacagtcagtgaaataggacgattgacttgctatctcccgtggtgggcagtcaggtgccagcaaaggtctttaaataagtcaaagcgaatgggaagtgctggctcagggcaaactaacctgcctgaagtcactcatttgtgtttttgaagatgattttacaattctctctttctgcagttgattattgatacacccacaagtccagtgacaagcggacttccactcttctttgtcattactgtgacggctatcaaacaggtaagcattttacagacgaaaaagaagcaatcgtcatcttcaccatgtgaattgcctttcattcaaagcgaggtgattggtttgttgtagctagttcacagaaaattcaaccaagttctagaaattcatttttataactgcgttagattgatacttgaagcgaaataagagatgttatataatttagttgctagtctggcaccatgcgagttcgagaagaaatctgtggttttcacatcccaaatcacccagagatgatctgatcagatgagtcacttaacctttctgtatccttgactgtcttgaccaccacagaacatgctgtttatggactccagcaaatgggatgctgttttttgtttgtttgtttttggttttgcttttttttttcatagccccagtaaataaggccagtgactaacatggagaagaatacatctcagttttactctctacgtatccattttatcacccccagattccctgtacacgtgttcagtccctccccattttctcctccccgtccctggcaaagactcatgtttctgtcaccgtagagtcgcctattctaaacatttcgtactcacggctcataggcggtgttttgtgactggctctttcactcagcatgatgttttcaaggtttctctgcatctgagcaggcgtcagcgcttcattccgtctgatgaatgagtcacggtcccctgcacatacctggcattttgtgtatcacgcgtcctctgtggatggacatttggggtgtttccactctttggctgttctgaataatgctgctgagaacatttgtgtttcacacccaccagattggctttcagatgtgaaaggctggagagggcatggcgagggaggcaccacgggccgccggcaggagcgtggcggagccaccaagcacagcagttggcaacatctgacacaggcagagatggggacacacagggtccagtgcagatgataaacatgcagctgtgcagtcagtacatggggcctgtgtgtcttcactaggccagagccggccgtgcctaccgggatacgtgaactaggatattcatggtggctgtcattgattagcaaaggactcgggcaacctggtgtccctccgtaaggaaatggacagctccgccgcggtgcatggcagaacacagcacagtaacgaaacgaactgtgctgcctggagaacagaacatgagggagactcacgcttcccaaggacgcgctgcctgtgactcaggcagtttaactcctacctgggataaggcctcacttcatgtcggtggcaggctcttgcaaacttcaactttaagcaaaacgatgggttttctcatcaacttcacaaggaaatggtgctgaaggaaacgatgttactcggggacctgccatgtgtcctcgggcccaaagtcacagtttccaggaacccatcgtggagattaggtgagggcgtcccgtgctatctgtgatacatctgtgtggtaggagcagaggctgcagacaggaaggagacccctgagcctctcaaggggagcagagagaaggggcgcgggggtgcagaacaaggggctgaggctctatggctctgttctttccagcctggccccaggaggcaggcgtagcactgttcttcagcgtcctcttctctgcatttgttaaggattccatccctcccgggactctactgagcaggaaactcctgagatctccaggagtgtcctggaggagaggagaggagagcgtggagtagggagggcggctctgaagacgcatctgggccagagaggcagcggccggggagcccgagcccccatggatgcagaggctgcctctctacactgtgcagaccacggccccagacaacatgtggtgtcctcggcccggctgtgccccatccctggctgtgtcccctcccatcggcctggctatgtcccctccctggctgtgtcccctcccatcccagggcagtgggcgggcgttttggggatgttaagagggggtcagggcaaggcggcaaatgaacagagctgcagttctgggccccatcaccagcacccctgcctctgcccagaggggtctcttcctctcccgcgcgtcctgctacccagctttcactctggggatggccttgcttcccctactgctggtctggacctgtgtgtgccagagcccccccaccccctcgaccttcccccactactgacctccttgtccctcttccttgggaacagcgcctctgtccgcagctgggactttcccaaatggcctccccacactgtggctccagcagggctgtttgtgctggggtccccatgctcccggcccctcctcgcttgccttggaaagccccctgcactcacagaggcctccctgattttctcttaggtccccgcctctcttttcacaccatctccccgctgtctccgctgggcactgacgggcatctcactgtacctggctctgccgccgccatcgcccaggtcctgccagagcggcctttccctgtggcacccagcctcccctgctatgtgcagggcccctccgatcagcccatcacatgcatgggcctccacgtgtccttcccgtcccagccaggctggctggtgggcagtgccagcccctggggactccctcaccgctgggcattcctgggcacctcctctttggcgtcttcccgcagcccgggcgctaggcttttcggggatcctgggtgtctctcacctgcattgaacttgcagttatttctgtttcttctccaccaatcctgagagcagcagctctggggacaaggtctttcgtctgtgggcccctggtgcctggcacttgctgagcatgcagttggtgctaaataagtgtgtttaatgaacccaggaatcatctacccactgccaccttccaggaagactgttcttcagtttccccagaaagagagtatttcagcgatttgggaggaatctctgaaaagcaatcagatgccacagtgtcacttattaatggtcacagctggagaaagctcgcacgtttggatatccatgcgtcccaggcttcttaattctccagaagctggaggttttgggttacttgtttatgctcccttcggaggagactccagtcacagggccactgatgccgccacgtggcccacagggaggaggtccccagtgagcctcctgccccacaggctcttgcaacctacctgcagcgggcccgtggcacaggcttcctgccgccatcctgtgtggttgtgtgtctcagcacacatgcagtgggcccgtggcacaggcttcctgctgccatcctgcgtggttgtgtgttgtgtgtggcagagctgtgtttccaatttcgacactcattagatgcggtggacgtggacgcccataggcccctggtgtgcagtctctcacatgctggggattgttactgagaacggcattccccatccttatctaaggcacctgcacccagcaacgccaaacacaaaggcacgtttgtcatcccaggaatcatctgtgtgcagcatctcctattgtcgcttctttcaagatgccacctgactgtccaaccagagggtgtgccttcgtagttggaatcggagtgcacgtgtctgcgccagtggaaggcatccaggtccgtcagcgcggccggggtcagggttagctcaggctgcttttccagccccctgcctgtgcgtgcacgggagtcacgatgggatgtttcccgcgtgggttactcagatgcggaaacgcacagagagccttaaggctgctgcgggtgtcacagagtgagccggcgtttcaccgagagtctgggctgccagatctcataacaatcagtttttaatgaaagagaagaatggccagtgggggcttttccaagtggaaggttgacactcagcgggtggaaatgtaactggctccacgtcttcggggcttttcggtgtggatgtgaagagcctggaaggcttgctcatcatttcattcagacacttcttttttaggaatttatcctaagtccatgtcatgaataggcacaaaaagtacagttgtatagtacttatacacacttcgatgagcatctttctccaacgtcttcgaagttctacaactgcagacatttaaagcagctcgcgttgccatggaacatgccgatgctctgtcaaggatagtgtgtgtagtgcatcctcatgctgaaaaatacacccccacaggcttggattatgcttagacataattaaacacaagccttctgtctctccctccctttctcctccttccctctctccctgcttcctctctcccttctttccttcctttttttagggttatgaagactggcttcgacataaagcagacaatgccatgaaccagtgtcctgttcatttcattcagcacggcaagctcgttcggaaacaaagtcgaaagctgcgagtaagtgacacccgacacatttacgctggtgaagtccagtaactgtttaaaaaataagttttacccaggtgcagtggctcgcgcctccagtcccagctactcaggaggctgaggcaggaggatcgctgagcctggaagtcggaggccactcaggaggcttcaccgtgcctgtgaatagccactgctctccagcctgggcaaccgagaaagaccctgtctcttaaacatttttaaaatacaaataataaatgtttttaagtttttattttctttggcaaaacagactgagatgttttttattgggtgtaggcccaagctccctacttcttttttttttttttacctttaatttttatttgtttatgtttaatagactttttagagcagttttaggttcacagcagcattaggtggatgtacccactgccccttccaacacacacacacacacacacacacacacacacacacacacacacagcctccctctgccagcatcccacaccaggattggtggaatataaaatcattatcactgcccccatccccacacacaccctccctctgccggcatcccatgccaggattggtggaatttaaaattattatcaccacccccatccccacacacagcctccccatcaccagcatcccacgccaggattggtggaatttcatcccacaccaggattggtggaatttaaaattatgggaacacacgaaccaatcaagacagagaaagattggaaacactgtttctaaaatttgttttagaataaagtataataaaatcatatcaatataaactcgactaggtggaaatttatgaaaattggaacagaaaacttcattgaagattgcatttttttaaaaaaaatgtatttatttattttttaagagacagagtcttgctctgtcacccaggctggagtgcaatagcataacctcagctcactgcaacctccgcccccgggttcaagtgattctcctgtctcagcctccccagtagctgggattacaggcgcctgccaccacacccagctaatttttgcatttttagtagagatggggtcttaacaaaatgttggccagactggtctcgatctcctgaccttgtgatccgcctgccttggcctcccaaagtgctggaattacaggcataagccaccgcatccggccaaaaaattgttttttattgatgtataatagttgtacgtagttgggggtccatgtgatattttgatgcctgcacaccaatgtgtgatgatgaagtcggggtaactgggatgtctgtcacctcaaacattgattctttgtgttgggaatattacagttcttcttgaaggctgcattttaaatctgtttcaaatgaattatctgtgtaactaatatctcaatatgtttcaaaatatgtgattaaattatttaaatgagatagtttcaagcttatactagtcatttggaagcacctttataggtagaaaccatgagtgtggtttttcacgtttgtgtcaaggtagcggtcagcagcctgctccagtcccccatctgatgtggatctaggtgccaggcccacaccggccccttcctgcccccactggtcctcgtgcaccctgcctggctctttccaactcccacgcctccctccctcgtgcagccccactgcctccctggctgttttcccagctgagccgtaggaggtttggtgagggaggcagggagcaccccagtcctgtgcatgtggagagccaggtgcgttccagaagcctggagggagggcctccaagcagcccagccagcctgggctcagtgaacctctccggacaaggccgcagcccttccctgtccagtgggacgggaccccaggaggcactcagaggcccttcagaggagccagcatcaaccactaaccccccaccgctcaccttgctctcactgttctgtgtatcacacacgtcaccaaatgtacttttaagcatttaaacattttcacttataaacgtgctatccaggtgtttaaatgcttctgagacagcttttcccttcagtgagttcagatgagtgatgtttccctagaggtcgggggttcagagagcagatggccctggcctggggaacagccgcgagctccatgcctgtgtcagcaggcatccggtcccaggccttcaacgccatttcctttaatgattatatttcccttgcaaagccttcatacttgtagctaaacatctttcttaaaaaatagacctaaacagtgtctgcccacagaaaattgaatttttaatgtatcggtcttctgtgggaaatgccagctctgtatcctgtgtgtcgtaaccaagaggatgctaaacaggctactcaggacgagaaagaaaagatcaggcttttcctacaacggcagacatccagcttccatcggtcgtaatggctcaggcctttgagagtgctagagcgtcctagaaaagcagtcctttaattagtttttcttttttaattaaactttttatttcgaggtaattacgggatcacatgtggtagtaagaaataaaacacaggcatcctgtgttccatttgctcggatgtgctgcccagctctaagattttgtcatctcaaggatatgatataaagagaatcctgcagcctgtgaccttttggggttggctgttttcaggcagtctaattccctcgggattcacgaagtctgtgcaccagccattccttcccttgtattgctaaggagcgttccatgatgggggcgtactgcagtttcaccattcacaagttgaagggcttttcgatttttctagtttggggctgttatcaagagagctgctatgaatatttgtgtgcaagttttcttgtgaatttagttttcatttcttttgcataaaagctcaagagttggattgctgggtcatctagcatatccacgtttggttttgaaaggaactgccaaatggttttccagcatggccatcccatttcattcccacgcacgacgttgccagcatcttcaccagcactgggtgttactgctgttcctgatgtctcggtgcagcttaaatatgtccctgacggctctgtgggacatcttttcacgctcgtttgacatctgcatatccttgtcagtaaaaataactcttcatgtcttttatccatttttctagctggattctttgagcttctttttactgttaaatgttgagaggtcatataatctagatagtaatactttgtcagatatatgatttttaatactcagcaggatatttcacaaagcaaacgtttttaattttgttcaagtccaatttcttgattttttttttcttttttttaaaattattatttcttttgagacagagtcttgctcttgttgcccaggctggaatgcagtggcgcaatctcggctcactgccacctccacctcccaggttcaagctattctcctgcctcagcctcccaagtagctgggattacaggcgtgcaccaccatgcctgtctaattttttagtgttagtagagatggggtttcaccattttgcccaggctagttttgaactgctggcgtcaagtgatctgcctgcctcggcctcccaaagtgctgggattacaggggtgagccaccacgcctggctgattttttttttttcttttgaggactgtacgttcagtgtcctgaatgaagcattctttgcctggtcctagacccaaagactttctcccatgtttctttctaaaagtgttatagtttcatgttttacatttaagttcatgatccattttgagatgatttttgtataaggtgtgaggtttcagtcaggtttgtttctgtccttattattttgcccgtggctgtcttgtcgcccctgcaccaggggatggctggctgtcccttttccacggagtggcgcttgtactctgtcccagtcagttaaacacatttgcatgggtctgtttctggttccctggtctgtcccattggtctccatgcccatgcccaccaatcccacactgttggtcactgtagctgtctcagaaggctggacattggggatacgtattccttccccctcaatcttctttttcaaggttgttttagctattctagagcctgtgccttcccatataagttttagaattagctcatttatatctataaaaatccttgctgggattttgatagggattttactaaacccaaaggtccatttgggaagagtaaccctctgattttaaagtctcacaaattcgcagtgtgctgtgaccatcgtgtagtgggacagagacctctgtttgcagtgtagacagaagcaggtgacgccctgatcctggcatgcctcccgagtggcagtgagactggctggagccctgcagtgactcactcaagggttctgatgatcgtttccccttcagacatgcagcccagatctgcaatggcttcctcacccttcagacacacagtccagatctgcgatggcttcctcacccttcagacacacagtccaggccactgagatgccttcctcacccttcagacacacagtccagatctgcgataccttccacacccttcagacacacagtccagatctgcgataccttccacacccttcagacacacagtccaggccaccgagatgccttcctcacccttcagacacacagtccagatctgctatgccttcctcacccggcagacacacagtccagatctgcaatgccttcctcatccttcagacacacagtccagacctgtgatgccttcctcacccttcagacacacagcccaggccactgagatgccttcctcactgatgaaataaaatggatacagacacaaactagaccatgacctttaattaaaaacccacatgatcaactttctgtgattgatttttactttagtttttgaaacattgttgccacttttgctttatttgtcctcatgctttgatgatctgggcagcgccttggttctgttgatcaggaagctctcagaactcgattacctggttcataaaacgcctagatttagatcaaagcttctcacaggagtacttcccacttggccacgctcacagaacactccaactcgtcgtcttggtctgaatcaaagataaccttgttacaggtgtttgtctgtgtttttgctgcggaagttagaacattgaaacctgacctggtctttccttggtcccagcagaatgtctggcaagagtcttttcctgaaaccgtgtccacatccccgtgtcttcctgtgaatagatgagcagcttgagggaagcggtcccacaggacgggcaagctttcacggaggggctttccattgaccatcctttctgctttgtcctgtaggttggggacattgtcatggttaaggaggacgagacctttccctgcgacttgatcttcctttccagcaaccggggagatgggacgtgccacgtcaccaccgccagcttggatggagaatccagccataaagtaaggggccttttcattagactccagggcaggatcttcctgtcctgcttcggactgtgcccatgcggccacagaaactaacatcctgtttgaaaagtcaccgttttcatgtaacccagggagttacaccagccatgtttttcctcacttttccttcctcctattttccactttcttctttttcctttttaaaaataaattgtattgtgtatatttgaggcatatattatgatgttataagatacatatttttatagtgaaattgttattagagtgcaacaaattaacacacccacatctcactgatttcccattctctcccctggcacccatgcaggagcagccataacctactcgatgcggcaaaaccctgagcccagcacgctcttgtccactcagtgcggcaaaaactctgagcccagcacgctcttgtccgctctagtcctcgtgttgtacgttgggtttttggacagttcatcctaaataatgctaccttgtgttttttgacctacacctccccatttccttttcactttttctttccagtctcaatgtctgtaacaaccaattacctcaggttaacaaaaataacttcagtgttaacctgtgtcaattagctaatgtaccaaattcaggatttaatgaatagattgttggaattttaagaattttcattttattagttaaaattagtgtgaaaactggcctagaattatgtgaaaagtcacacacgattctagattttgcctgttacttcaatgagtgtctttttgtgaatgtatcttagtcaggattttctgaaattactacataagtaatttcctgcactcagtataaaattctgcacaggcagttgatgctacaagaattttaattgtcaatcatacaagaaaagatatagcaccattaattttaagattcttcttatttaaaaaatcttgaagtttctaaggagtttatgaaagtgagcatagctcagtggattcaactaagtcatcagctcacaaaattgcaactctaaaatggtatttaggtaatacgtatggatataggccatttctactatgagatagagacattttctttacaaaatcactgaaggatatgctagtctttcatagataattcatgatatgtatcatgaattgatagatgaaaaacctatggatctttttcagttaaattagctttcacattttctgtgtagcatatcccaggagaatgaacacgctaacctaaaagattgtcagcagtttctagggggtcggaatccctggatgattcaggtattcgctgtaagcgggtgttggtccctctggaacctgggaggaggttaaggttccatccacccagagaccctgtgagcccttcacactctctgcagccagtcgctgcctttacaccccttccctgcagactgtggctggtcaggctcagatgagtcccagccatgctagtgaacagatgctgtgggtctccagatacaccatgtttgtccagatgaaatgttgtagcagttgtggaagatgttaaaacagctattgcactttgaccttttgtggctttgcagtttgcattatagttttgtgttctctaatgtcctttttgtgcattttgtttagcttgagggactggaattatttgagccctttccttaaaagcagagtaggggcgtgggaagggtccacccgacctctgtttggatcccgtggggctcacgtgactgcacaggcctgttcacttctctggactcttcacatttgtgaaatggggacaaccctatctctcaggggctcttgtgaggataagattagaaaattcctactgaatttagaaaataagcgccccctgatttgtgtgcttggtgacggggcagtgactgttggtgtgcttggtgacggaacagtgaccgtttgtgcgcttggtgacacggcggtgaccgtgtgtgcgcttggtgacagggcggtgaccgtcggtgcgcttggtgacgggcagtgactgttggtgcgcttggtgacggggcggtgaccgttggtgcgcttggtgacggggcgatgaccgttggtgcgcttggtgacaggcgatgaccgttggtgcgcttggtgacggggcggtgaccgttggtgcgcttggtgacggaacggtgatcatttgtgtgcttggtgacggagcagtgaccgtgtccccctgatttgtgcacttggtgatgatgcagtgattgtttctcccatttgttctgactcctgtgttttatttgtccaatactcttccactagaaagaaacacaggaagggattcagagatgctgttgcctcttcgcagatccctgggcacaagtttctcctctctcctcccaaggcagggccggtgcagccctcatgcccacctcaggtgggccttcagccgacctgctggtgctcacagatgctactgaggtcaccaggcctcaaaatgtgttctgagagcagcagcatcggcatcactgggcaccatattagaagtgcagttctcaggccctccctagacccactgcatcagaaactctagggctgagcccaggaatcaggtgcttcagaagctctgggtaaaactcacgttgagacaggcttgaggagccccccggcccaggccatgtgaacagttaagtagaaggcctgtgccacccaacagcaacgggcacaggcaggttgttgccgagaagtgaaaatgaagtgaagtgatcctgtgaccgctccccgtaaacaacagggcgttctgtaaaaggaaagggatatttcaggtcctggatttgtttcctaattaatagctactactatgacagataaatcagtgtctacccttgaagaattcgagcattgctatctgtcctgttagttttaagtggaggacactgggtaagaatggaaggatgagaattttctggcacctgataggtgcaggaataacagtagtaccttatctttctgtaactattaaacatttacaaactcatagggtcagccaggctttgtaatcacttggttggaggcaccagcgtctgggtttgtgttgaccgttttggcggtgagctcacatgtcttgtgcatttgtagacgcattacgcggtccaggacaccaaaggcttccacacagaggaggatatcggcggacttcacgccaccatcgagtgtgagcagccccagcccgacctctacaagtaagcgggagctttgggttctttagaaacggttttttatgccctcaacattgctcttgctttttcaccccaagtagtccagccatgtggtggtttggaaagagaatgtaaatcactgcttaaagattaagactgagtcaaaaatacattacttatttattctcatagacttgtaccactcagatttgtagctttttatacaaatatttgaagtggcttcgtggaaccatatttgtgggaaaaaaaaagaataagttttctttattttacggaagacgtttgtaaactgtgggttaaggaaaatcaccgaagccatgagctgatcagaacagaaagtacgacaagggaaggggctggagcggggctgctttagccgcacacggagcgggccaggtgaagacgtgtggctcacagaaggcaggtgggccaggcgcgcgcttcccgggggccgctgggcgcgtccggtcagtaacgtggcttttctgtcgccaggttcgtgggtcgcatcaacgtttacagtgacctgaatgaccccgtggtgaggtgagtgcctctgcggatgccttggccacggtcacctcccttgttgcgttagaaatgcattctttgacggacaagggtttccacggcggctgctctggtagatttggaaggtggagttccgctttcccacagggccgggctccactctcgtctctggtttgtctcaggcacacatctgtgaatgttgacaagttagtgatgctcgtgaaacaagttttcgcgcaagactctgccgagagggtcgtctcacaggccaggaggcgtcagggtcccgtggagcagtttcaaagtgaagggcggagtacagcttccctgggagaaatgccctttcatgattcgggtactgatttgtcttcagatatgaaattgaaagacttctaatttggaggccgtttttgggaatctgttcatccactcaccatcattctggggtgcattactggctcaaggcctatctgaggctcacacctacctgagaaggtggaatcggtagccggggcaaggccgggcagctcacggttggctgctgtgccttcccattcaccagcatggacccagcggcagtcacatcgcatacccatgaggaaacagcgaccctcagacacctcatctatggccccgaggcagcctcggctgagagccagcctgtgctgagcccagctctgagcagcacccacctcccaggcctagggatattttctctgacattatttcaagatctagcatttgttgctgacgagatatttgaatgtcacagtttagggaattggctttcactggattttaaagttgcatcttcttcataaactccacttgttagggaaatgatttttcttccattgtaagcactctccaagttgttgatgtctgggtaggtacagcattgtgtgttaaacaacacatctcccagacacagaaacacactcactgggaaactactgcaaagtgaatagttcctgaaatgcttagctccttgtaagtctccaggagctactgttttaagaaaaccatttgtgcacttcttagcatgtgcttgttatcattacccatcagcaggctaggaggtgctttcgagaactgatagtgaccttgccttggtttgcctacgtatatactgttctaaaggtaaattcctccttactttggagaaatctcttgtatttctgtgtgccgtgagaattaatttgtgtttgaacagacttaggcttattcatattacctatgggatgaatccaaaatagtaaacattgcaggcttttcatctttatagttagaccaagtttattgctgaacaacttgggacgataattgctaatgtattttgcattttgatactaactctggtttcacttttattttatatattttattttattttattggagacagagtctcgctctgtcaccagtctggagtgcagtggcactatctcagctcactgcagcctccacctcccgggttcaagcaattctcctgcctcagcttcctgagtagctaggattacaggcgtgtgccaccatgcccagctaatttttgtatttatagtagagatggggttttgccatgtcggtcaagctagtctcaaaacgccctcaggtgattcacccacctcggcctcctagagtattgggattataggcatgagccaccgcgcctggcctagtttcacttttaaatatttatggtattccatagacttttaatatttagattattgaagatgtttgtaaatttgtgatgtggacagttaagaattacgcacccaaattctcaatccattcagagtgacgtttcttcttccttctgtcctaactagaagcaaagtacttttccaagtaaattatttttagacttccctgagtcactttttaaaaacgctgtttgttttcgtaaacacatggcaggaattattataagtgtgttgcaaacagaagctgacagtccttataacacagccagacaacccatatgcagcctgggagctccatctttagtgattgccggggaggacgcgcgtggagccctcagccgcagcctggggtagacagccccactctgcctgtcttcagccggatgcagttctgaggtctatcgaccaaatatactgcatgcattttacattcataatattcagtaggttcttaattttccatgatagaaggacagtaaatacaatgataaatgaaaagcaaacttcagcaaacacttttgaccctttaccctctgaagcaatcctctgaatgttatcaatagcaaaatttatacatttgaatcttgctgcttatttctcccttactacttaggaaatgagaagagattatttttccatcagcagggaaccctgttatatcaagaatataagcccctgatggcagagaccctgcctgctgcttatgtggcttcagtgcacagaacggggcttgttcttccatgtgtgagatttttaagttctttggctgttgcttgttttccccccaaagcagccatgcatggattgtcccagatttacatgtcccccccattcagaggagctttgcagtgtggctaccagtgtttctaatggccagatagagtatcagcctttgtctccaggaataagactgtgtttcatgggactccctgaatctcactgaggatgtaatagaaacaattgaggctgggcatggggatgcccaactgtaatctcagcactttgggaggccaaagctcaagttcacctgagcccaggaggtcaaggctgcaatgagctatgatcgtgcccccagcctgggcgacagagtgagaccctgttgcaaaaaaaaaaaaaaaaaaggaaacagttgaaagttgagtgacttttattttatttcacatccacccctctttagcctttccagaacattctgggaccttccagtgcagctgttctcaacctgaggcttgttaggagagggctgctgggccccaccccagggtttcaggttctgactcggtaggcctgggacgatcttcctgactagtgtgatggttcctgactggctccaggtgctgctgacggcactggtggggccacctcagggacccctgctctagaggtctctcggggagtgttgctgaggctgccgggcgcagctcagtgggtctggatggggcctgaggtcccgcatgcgccaatgggaggcccttgccgctactcctggagccatgtgttcgtcccccaaagataagcccacatctgttcacatggacctgggctgacttaatcatctgaatataagcaaacctccgtgtatgccatctcctctgaaaatgagatctgctgagcaaacaagtgggtttcacgtctgcctcttgccccccgccctgcccacttgccttcgtgtccgcatcatttctgatcatcgtatctttacaggcccttaggatcggaaaacctgctgcttagaggagctacactgaagaacactgagaaaatctttggtaaatatttaattaattattaaccattgcccctaacattaaggatgcatgaagcaaaagttaaaacccgcagcggaacccgagagcgtttcttggcaccttgaggtgctggaggctttctggccgcgcaagttctgccccactgagatttgatcagtgaataagtgcaatcctgaagcagcagcatcagagaatacggcttacggattaaggcctctagttttggattcagaaacagaacattgcatccgtgaaggaatttgtgaagtttagttgtgcaggaaatgtttttcatgtctgcgtttcttgactaggatctcccatttcttgtgggttattgtctgttttaattgaggtaacctttagaagtatacaagtgtgccccactgtcagaaaatgctgtgcaggtgttcctcagtgtccttgggggactggttccaggatgcctgcagatgccaaaatccacggatgcccaaggccctatttgcatgtagcctacgcatgtctgcccctgtagttcacatcatcttagattacttctgatacctagcacgatgtaaataccctgtactgtttttatcgtctgtattttgtatcattgtattgttatttttattggggatttttttcaaatattttccatccccagttggtagaacctgcagattaagaactcgtggacatggtgggcccagtgtatattaagatatgaactcttaaaaaatgaagcatagattgcttcctatgcatgaagaagggtctttatcctaaggaatcaagtgctagtgttatgtggctatggacactagcttatgaaattaaaaataggattcgctttacccaagaattgattttccccgcagctgtgtgtaactcaccataaggcaagacacacttgcgccctggtcatcacccttgctcttcctctctgtaggtgtggctatttacacgggaatggaaaccaagatggcattaaattatcaatcaaaatctcagaagcgatctgccgtggaaaagtaaggctggatgcgcgtgagaacctgcaacttaaaagtgtcattacccactgtagaaatggaagtagcttcctcttggccttattggcagttcctttgccactgtacagcatcttagtaactgcagagctgaccattcagatggtctttcttattttgtggtgaggtggatggccacacccctccttcctgctctttctaacgcctgataccaggttcacagcgctgcctcttacggacgccctgacgttccggttctgaaatcagttcagtatccaacagctcctctcaccatttcatgaaaaactccaaatgggcttacttttaactctgggatttggtcaaaaccacgtattctctgctatggttttacaaaggaaagcgttagcagagagaacagaatcatcttttcattaaacagtaaagtcctgatgataaatatgtcaggatggtagctgaatttgtgctggaaaagaaaggcttcttcctgagatctgctaagaccttagttaaggatctgtgcttttcctgtactgaggacacttcctttcagagttatttacttttctccccctcctttcctccctccctctcttccttcctctcctttccttccttcctctacagtggtgggtagtcactaagttttgaactaatttgttgatgcttaatggtagaaattgatttctggatgtacttttcaatgacggaagtccaggcagtgcagaagcatggtccgcagtgtggctgtgagcagccctctctctcctgcttgtggcactttaccccgtcttggttcttacctttgacctctagaagtacgtgccagggaccatggcatggacgcaagtgcagaggacccaccgtggtgcgttgagggcgaacacatcactgtgcccttcctattctgtttcttcacgaggtgtcatcttgatatctgtgagaaggaagtgcagagctcatttcctcagggaccagtgatcacctctgtccttttgttttagatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctggtatggagaatcactgcccttgtatgatccgaggtgacctgtgggccattattacgaaaatgtggtgcaagaaaaagatgacggtgaatttactgtaggcaaaaagcagcttgattgattcagtctctgtgatagatgcattcactgaaatttaaagtctcagtggacaccagctgctcctgccatctttggatctggaaaggtacaggttcccacagtgaaatcatcaggacaataccttaaatacttgcactgtgtcctttgtttagagagtgctgagaaaatgcttgttaatgattatgagataaatggcacatatttgtggtaaatacttggaaaaaagggtctgctcccagtccagagcagggccatgtgcaaaccgagacctgtgtccactgagcctagagcaggactgtgtgcaaacccagacctgtgtccactgaccctagagcagggccatgaacaaacccagacccatatccactgagcctatagcagggccgtgtgcaaacccagacctgtgtccccactgtccagagcagggccgtgtgcaaacccagacccatatccactgagcctggagcagggccgtgtgcaaacccagacctgtgtcccctccgtccagagcggggctatctctgcatcatctgtccttcccacaaaactaacatggccccacagatcaggataaaagtatactgaaaagtcatttcaccaggcttagtttttacatctgtaggttgttaccaagtatgttttgttataagagacacaaagagatcccatgaatatgcagaagtaaaattgccgctggtgtctggttggcgtgtctcctgtcatcggcacatgcttgtcttaactcgtgatttaatctccacttgctggcaggacagccccacagctcagcccctggacccggcaggtcctggctcagagaccaggtgacccagtggctgccttccgcccatagtccttgtctttggactctgaaatcttgtatttagtagtagcgctcgtataacttatgcctaagcctgaggtgttagagcagcatgttggaggcctgctgtccctcctggtggaggtgctgacccgcaccttctgctcttgcagttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggttggtgtctcctgagtcatctgctgtgatttattaacatctgggtgagtctgcttcacgttcctcaggtcctgtgcctgtcatccgagcgtggctgtacctgtagctggcgtaagacagcagcagggttgttttgaaccctatttatgaaacagtcagccgtgctgttacatttacaacagatgcagaattacctgcacttgctgactcctggaaactcattggagcttcctgggcagaactctttctgtgtgcaggtgtgaatcaaggctggtgggtaaaagtggctttgccagccttgcactctgcttctgcacctgatattcaagtctcatggcgagctgggtattttcactttaaagatgaacaaaccagattttcagtgacttggtggattgcaaagagttcagacgcctccattcagatcctgctgctgcatgatggctgcgggagctcgggcttcaccgccacacctcgagtgtctcagtctgtgaaatggagatgataacagatgctggccttacaggattgggttgcagattaaatgagataatggacacaaggtgcacagcacagagtctggtgtgaccaccgccctgccaccgcaccaccgggaggcacacaccagacctgctggcttgaagggagctagggaaagacccattccctgggtttccccagcctagagcggtgaccttccctaccttcccagccttaacgttgcagagtgcagggttgccggagcaggtaccagtaaacggtaattggatttttcggaagaaatagcgattttgaaggatattttagcaaacaaggccactttagacaggtagctgaaatctccatctcgctcccagatgacagcctgtaaatagacttagactctggcagatacagaggcctctctctgcctcctgtgaggaaggccaacaaacggaaggatcatgttccacatttgatgagtttgacttttgaatgtgttcctccagcatgtcccatactcctcacagtgctttattgtttgagtcagcaatgcgcaaactataatttagttgttcaatagtcaggtatttttatctaggaatattctatctcctttgcaacaatagatggtacattttgtgagcttctgataaattctttgggaaagaacttttttctgtaacaaggaaagtgcccagcagcgttgagtgtgggggaaagcgcccagcagcgttgagtggggggaagcgcccagcagcgttgagtaggggggaaagcgcccagcagcgttgagtggggggaaagcgcccagcagcattgagtgcgggggaaagcgcccagcagtgttgagtgcaggggaaagcacctagcagtatggagtgggaggaaagcacccagcagtgttgagtaggggggaaagtacccagaagtgttgagtaggggggaaagcacccagcagtgttgagtggggggaaagcacccagcagtgttaagtaggagggaaagtgcccagtggtgttgagtaggggggaaagcgcccagcggtgttgagtggggggaaagtgcccagcagtgttgagtaggtgggaaagcgcccagaagtgttgagtatggaggaaagtgcccagcggtgttgagtgtggggaaagcgcccagcagtgttgagtaggggggaaagcgccaagaagtgttgagtgcgggggaaagtgcccagcggtgttgagtgcaagggaaagcgcccagcagcattgagcacggcagatttcttctctgccctcttcagtccatctccttggagttctgcaaaacagaatttaatttctgttgttctgtcctgaccaaaaccaggctccagcttggaggctgacctcctcgtacacaaagaagtgtgtactgttgctcacgggggacacactgaggtcaagacgggtggacaagcccaaaaggcaggttcatctgaccgcagctctgtgggtaaacgcctgtgcccactgtcgctgtgcagtacgataacacgacttcttttgtatgtgaaatagattcacccaccagtcaagcgtctgtgtccacaacagaaacaaccatctgccatggagatcctgtgccagaagcacttcgtgcaccttctctgtgtcctgtgcacactttatgcaccttctctgtatcctgtgtgctcagtgctattgcgccgtttctcaaatgagaaactgagtcaggagcaggcagtgccccgttctgcgatgcagtgctgcctcccgagcacgagtgccttggaacacaaatcttgcttcaggccaagttagcaggcaggcgtgcgttgtagtgagggccatcttttgttcctagagctgagggtgatggcagcattgaccagcactgggcttagggttgactgtcccaccaccagaaaagaaaattgcaggccaggacccctgatgaacaaagttgcaaaaatcctcaacaaaatactagcaaaccaattcagcagcatacaaaaggatcataccccacctgtgggatgccagggtggctcaatgtgtgcaaatcagtaagtgtagtgcattacgtctgcaaaatgaaggacaaaaccatatgattatctgtgatgcagaaaaggcattggacaaaattcagcatcctttcataacatctctcaacaaattttaggtatagaggaatgtacctcaacacaataaaggccataaatgagaaacccacagctggcaatggagaaaaggtgaaagcttttcctctgagatcagaaagaagacaaggctgcacacattcaccccttctatttagcatagcactggaagctctagccagagcagtgaggcaagaaaaagaaaaggcattcgtataggaaaggaagaagtgaaattgtttgctgatgacacaatcttatatatagaaaagcctaaagactccaccaaaaagcttttagaactaatcaacaaattcactaaatttgcaggatacaaaatcaacacccaaaatcagtagtgattctatataccagacaagaaactatttgaaaaagaaatcaaagactttaataaacttgcttaatagtaacaaagcaaacaatcttatctctgcgtcccgagctaacagaactgactggatttgtgtccagaggttttaagcttttgtttccacgttcttaaaactgggataataacacagttgatgtgttaataacagttgaagattaaatgaggctctgcccagtggctggcacaccctgagtgctcagtaaaggtcttttataattaattttttttattgttcactttcatggtcatgtttcctagaaatatgccacctatttagttatagctaaacaggatgataaaccaaacctcttaacatttgttatctcattcttatccattttacccttttaaaaatgcttttagggccaggcacagtggctcatgcctgtaatcccaacactttgggaggctgaggtgggtggatcgcctgaggtcaggatttcaagaccagcctggccaacatggcgaaactcccatctctactaaaaatacaaaaattagccagacgtggtggcaggtgcctgtaatcccagctactctggtggctgaggcatgagaattgcttgaacctgggagacggaggttgcagtgagccgagatcataccactgcactgcagtctgggtgacagggtgagactccgtctcaaaaaaaataaataaaaataaaaatgcttttgggattgaaaagcgtttattctaagttacttcaaagtcctgtataagaagggtacacaggttgaatatcccttattcaaaatgcttgggaagaagtgtccctgtggacgcgcccaagctcagtctcaagatgctgccgtgcgttccagaactcctaccttcagttattcacgataaacgtgtgacccatgagcttatctaaaatcagagtttaagacgggttgtatctttaacacatatcacagttttctctgagatttgttttgtccttatttgcttgaattttaccttctcaaccttacatggtattgtaggttttgacctccaagactgtatagagtaagttcgtcctctctgtagccttggttttttattgttgttgttaagattcgggacaacccacttacactctgtcttcccaaacaaatggagccctggccccacccatgtctctgtcccggggaatgggactatgagaccatactctgttttgctcccaacccagagaaggtatcccgaggcctccccacccatcctcctgaattgcacctgccaggactgcagggtcctgttggacgctgggaaggaggatgaggcaggagcatggctcagcccagtgagggggtctgtctgggggaaagcctttagaaatccaccgcctattcaagtcacagtgggagctggggaggaaacacggctgctgtgtgtctgagtcggggacgtgcgggcctccctcagagcgccctgacttgctgtgccctgcccgcaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggtaggtggcagcccccacgccgtccaagtgtgtgagtgagtgggcggctgtgcatgctgagtccaccccttttcactcgagtgtccaggaaaatccaggccctctctacggacttcagtgggagggatggtcagaaggtgcgatgtgtgtggtgtcccgttaggacacatctgctcagtgatacccgtgttagaattggttatgaaaaccatagaagcagggcaaacacacatgcatgcacccagacaccatgtgcacacggacacacatgcacacacgctcacatgcaaacacatgcactcacacacgcccagatactgtgtgcacacacacacatgcagacacacgcactcacacatgcccagacactgtgtgcacacacagacacacatgcacacatgcagacacacacactcacacatgcccagacaccgtgtgcacacacagacacacatgcacacacgctcacatgcagacacactctcacacactccctgacactgtgtgcacacatgctcacatgcagacacacacgtactctcacacacgcccagttaccgtgtgcacgcacagacacatgctcacacgcagacacacacatgcactctcacacacgccccaaatgccgtggctccagatctcagcatctctgggcagggctgaagtcccaggctgatgctgttcctgaatttccccgcacacagggcagcctcggggatcaggtcccagccggctgtggccctgagcacatcacttcaccttcctaaacgctgattctgcagctgcaggcgcaggataatagctccaacttcttaaggggtttcagggtgaatgtgacaatgtgagtcaacagcaggagcgccacaggtcacgcctagtctaacacacgctttggttaggagaacgtccccatcgcacaggcaccagggcagaggcacagccagggtccagggtgtttgtgaatgtctgtgttcgtggcaccgtgtgactcagtctcccttcctggacgctagcggtcacttgccatttctgagcgcacgtgaagcctctgtggtttctagaagtgtcggtgctgaacgcacgcccgtttagccttcctcacccgtcagtctcaattacaaaacagagtgcttgagaacgatggaaagctgtaattccatcccactgtataacccctcaccgcccacaagctgccttcgtggccgcggggaccccccccaccccgcttcttgttatctctctgcgcctgtttccctctatcttcagtggacgcaccgtgatttgggggttctgggaactgcttttttataggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagaggtacgtcgcgggccaagggtctgcctgggtttcctgatgtgactcagcccctccccagccccagtcagggatttgcacctagaggcgtcctcagccccaccctgtgccctccacactgagctgtgctgcctttgcacccagcttctctggacccccgtccctgtatgagcccctcccaccgtgataagcagcgtctggtccccggcgcgtgagtcttcatctctgactttgcgtgggtggcttttcctcctgaggtctgcagtaagttagaggtcattccaaataaccacaggcttcaaaatacggaaacaatcattcttttaacacaaatctccctcctgcatctcagaaaactgaagcccagaggcccagcggccttcccagagccacagcctgggccggacagagcagagctggtgcgggacctctcaccgcccaccctttaagcaaacgcttggaaaaatactttaaacattccagatacatggcataatttcaactcaggggagccattttcaaatccatccagctcatgacttctgtattactgaacctcccctccccaaaagtgccttcagggactgagtatggtgagaatcatgttcgcgcttctcacctcattacagccatgtttttgtcgctgctaaactaatgtgttttctccatgcaacttgagtagcagcacagatacgtcaacagtatcaccggggcccttcgttccatgcgtaaacccacacatgcgtaggtgaggcttcttggagctgggtttctctcttcttgaaacacaagtgcccaggaatgccactgccttcatcacaggtgttagaagtcagggcaggctaccccgcccacctttgagactcctccctgccctgaagcttttcctccagccgctgctcccacctgggctggccagaggcctccactgccatccccctggtgccgcgaagcacgtctgtctcccgggtcctctgctggcctctcgcatcccaaagccatgctctgtctctgccgtcccagtggctcccacaaggccctgaaggtcgctgacccccaggcgtgcaggaggaggcattgtatagatgggtgcacccacgtgctggctgaaggcctgcgctggaccttcgttccccgtcagtgactcaagggccttggtgtgggggtaacagcctctcagggtccctctccctctggcatcgtgttctccgctcaacaacaacaaagtccacgaatcaatgagcaaaagtgtcatcgaagcaaggattgcaggccatgtgcctgccatgctcttctggagaacaatactgacaagaatgtgcctcactgctgtgtgccaaggagggttgggttgggtagaaattctcttgctcttggaagattttttgagatggtgaataagttcattatgataatttcctaactttataatgcagtttataatctctgtttaactgaaagtatttcttttttgaaaagaacgctttaccaaaatataaagcaaatactctatgaaagaggaacatcagaatctcagattcaccccgaggtttcccttctcattgcagacttggctttacctacctaaggctgaaggacaattacatggagatattaaacagggagaaccacatcgaaaggtatgtgcagacctcaccctcagatgtgaaaggactaacgaataaagagtgttctttataaggttctgcgtttgagggaaaagacaagttctctatgttctcccacaattcgcttcctctccttcccagtgacaccccaggaatgtcaccagaatgttctggagaagtgctggacacttagagaagggcttgggtgcagccacagcgctgcttcccctggatggtttttcttggagatgtaaattggagttcagtgaacaaaagttcactgtcaaatatgttttgggttaagccacctgaagtcaggttttgctgcaggccgcgttctgacctctccaggcccctttgcctccacgaggggagtgagcagctgcccccggtgtggccatgagtcccgcagggaggaaccctggctcacgtgctgggagcacagcgtcgtgtcgaaaacagtttgcacagttacgcttttcagtcaccagtttgatgttggattgttttacttttcatatctttaaaactcttcccattttttagggactgtctctgtcccaaattgcttgtccctgagataagtgacccatcttgagatctgactcaggagagggggtggtggcttatcaacaagcacgaatgtgcggtcatggttccggcaaagacacaagatctggtggtgatggcctcaaaacacgtggattttaaaatttcattcttagggaaaataaactccccagtggaagagaaaggacaaatcccttgattcggcggggctcctgggccctccgctggcaccagctgcaccctctccacagcaccctgggcttcccgggggccgcaactcactgccgttgaggctccgggtttgcagccgtggaggtagtgaggtcgtggcctagatgagagcccccatcagggctctgccaagggacccctggctctgagctgggctggcactgcggccagagcccctccgcagcttcccactgagtccaaggccctgaggaggctgaggggcagcagcgggggctgccaaacacttccgatgctccagacgccacacaggttttctgagtcttccggtaacaggacagcaccagccaaaacgctttttcctttggttttgatctcttagggtaacgccagttcattgacaaggatccaatctctgacacaactttgagtctctgttcagcggtgtttagggagggagtcggtgcgtagggaacgcagcctgcttggcagaatctgagcctatgccctgggtaggatggggacgtagtgaggagccggtgccacagggcccagactctgccccactgggtacacctgctgcgtccttcaaatccaggcctctcagggcatccatgggaggacacccctcacccagcagccctctgtgtgtcccctgaggaagggccagggctgccccagccattctgctgtggagagctccacagttaccagatggaatcacgtgagcacccgtgtggacggtgtgaccttctgcatttctctttcaggtttgaattgctggaaattttgagttttgactcagtcagaaggagaatgagtgtaattgtaaaatctgctacaggtaaaatttctttttcttttgatttattaagttatacgtggtggttgtgttttattctgatgactaaattctacaggagctttaaggatttagggtttaagaatgatttattctttttttaaaaactatagacaaatcctctcaaaatactaattttttatttttaaaaagtgcaacatttctggaatgctgaggaaggagtcctgggctaaacatccggcacccttgctctgtccatcttttagtgtcgagttggggccactttactgttgaaaattgcttaattccatttgtgaaagttcctctgcccatccctatcccccacccgcttttctccatgcagagctaaatgacataaaatgtttttaaataaccattttcaaggaaaaggtaatgtgggtttgcaaatgtatctataataatgttcaaagttgcaaagtgagctttgttgattggcagttgccgtaacagtgtgtctgtgagaacagcacactcggttcgtgctccggaatgctgggatgagcagtggcggggcacagtcagagccctgtggccgccatgatgttttggtgacccacacggttgggcactctcctgatcctcccactctgacctgtggctgcccctgtccctgacgattgcctctgcagtccaggtggatgcatctgtggtcccctgacctccctgcgaggagctctcccaggcactttgcatcccccaagcacaggtggacgacctcgtctccccccaccctcagcaggtcacgacacatgccacaggtcactcaacaccgcagcccctcaggctcccgcccacagtgctgaggcttgaacgtgcaggcgcccctggctgtttgccctggacaggcagggcccgtgggctccgtctgcagaggccacccctttgcatggccatcacttcctaagagctcccaccgccccctctgaggctctcactcaccttcatcaccaggttgtcctcaagtgtccccagagggcactgcccacagcccccacagtggccttgttccccgcttcctgccgtgggctttcccataggaagggcctttcacccatctgtcctttccacggacggctcaggaagcctctcccggacctcagccccatagcagcgtgcaggacattgctctatggtggagctgtctgtccgtctgcagccactggctgcctgcacgcatcccgaacgcagaaccgatgctcttctcagcaacacgctgacgtcacgccaccctccgccgagtgctcccaaatcctgtgccgttcagagccctccacgcagcgtcagagcagggcttcattaagagctgtgggatctcactcttcattgtttcctaaaaccagacactcccaggctgcatttagctctttggaaagatgcctggcaaacaaccaaacagccactccccggaaccagacaggctggagagcttcatgccagcattttcctaagatgtgccgagtttaattttaacacagtagacagagcagggccatcatcagtgccgtcgggcacccttcggatcaggaccatggtgcctcacttcctaagaccccgaaggagctgtagggggaggcagtgtgactctcggtgacgccctgtgagtcatagcggctctggggtgggcagcagcctcaggagggaggagggtgccatggctgctctggggggctgccgcctgccttcgctggttccttagacacagtcccactgtgtcacacagcatcacctctgagacacgccatcaaatgtgggatgaatccaggctccacagtgagatgtctactgatggtcataggatgaggaacaatctgtgtgtgaatgttgccaggactcccacgaagagcttttgccagccagaccgtgggatcagcaggacagggtctgagaacaggttcagatgcgcgagacttctgtgtgtcagaacccttccccccggctcggatgaggcgcagtcctgagagtctcagccactcggagttatctgggataaacgcatcctgggtgggaagttcctggtccatcccgtcacgtggttttccccgtagcagtcgaatctagctgttgagccatggctggaacatgctgcccgtgacctgcggggctgactcacgtggttttccccgtagcagtcgaatctagctgttgagccgtggctggaacatgctgcccgtgacctgcggggctgaccacggtgcccaagaaggcaagcatcagccaccccggagccgcccctgccgcgcactcaccccggagctggccctgccacacgctcacaaggggtttttgctgcatcctgaatgcccaagacctcagggcattgtgggctatgccgtggaatctttgtaaataacttctgttactatcaaaaggctgaagagccgctggatcactcgaagaatccgggttggaggcatttgtgccatgagaatatccctatccgcactgggacgcctgtggacctcctagggcctctccaaggaactgagagcttgcaggagagacggccctgccatctgaagccagccactcatcagttacttttaagagaagtttgaatatgtaattaagcaaggtgttctgtaagtagtagtcatccccggagaggttcactaattgcactggagttctccctgctgggcggggagaccctgcagccagctcacagctcgtgtttcctcctgggctcagccctgtagggggttgcggctgtcagagccggatctcactgttttggggctgagcagccccaacaggggcctcccatgatgtccgcaggacccttttttatatgtctgtacctcagtcatgtgtgctttcctgggattctccacggtggaattttgaggaaggacttcggaagtcacaggccactcggctgcatcaggccttccctttcaaaggcagatgtgaaatctctcttttgggggatcctgcggatgcttactgcacccaaggtattatgtacgcagtacacagaagaccgactcgaaagaagaaaaggagagtacataagcatattcatctatgaaaaagaaaagcaagcagaaaagatgaaagagaaggaaagtcctaacagtgcaccctcctggagctcctccaggagctgcttccttgatgccctttttccagccatttcggggacatttgctgtcacgcctggctttccatgtccttgagctggtctgtgagacacagtgaaagaccccccaccatgggctcaaactgtggttctatagccctttctcttctccaaatggcagtaagcccttcttggtcccagaggggacagccaccaaccacggctgcacctgcgacacaacccagctgtcttggggacaggatcctgtgtgttcggttatgtcacctgtgtgtgcacggtcttcagttgctcattgtagattaacttttgctctgtcctctgggtttttttattccaaggctgttcctcaccaagtcttcaggctgaaggtgtcctgtgtcttacagtggaattcacaagctgagacagtgggaaagttaagccattcacatgctcttggcatgagttgtgagccatgaaacatgaattttctagtaaaaaatgtgctgttgttcaagaatgcatcattatgtcatttggaccacagttctcattctgaactgtatctgatgaaacaacagcgttggctggaaaccatgggagtcgggaaacggctctgacatcgattgggtagtttaacccccgggccctgcttttctatgctaagcaactgagactctgtggtcacacctctgcagttctgcagagatcctccagggtccaactcccagcctcagcctgctcactcccgtgccctccagcctcagcctccccactctcccgtgccctccagcctcagcctccccactctcccatcccccccagcctcagcctccccactctcccgtgccgtccagcctcagcctccccactctcccgtgccctccagcctcagcctccccactctcccgtgccctccagcctcagcctccccactctcccgtgccctccagcctcagcctccccactctcccgtgccctccagactcagcctccccactctcccgtgccttccagcctcagcctccccattctctcatcccccctgcctcagcctccttactctcctgtcccctccagcctcagcctccccattctctcatccccccccagcctcagcctccctactctcctgtcccctccagcctcagcctccccactttctcatccccccccagcctcagcctccctactctcctgtcccctccagcctcagcctccgtcctcccccatgccctccagcctttgctcggcactggtttgctgcatgtattggcaacacctgtgtcaccaggtgccatcctctctggctgcaggttggcagccacctcagccacatgagcgtcaagtgtagccatgttcccacagcttccctgttggtgtctcaggagttagtgcttcctggcatccaggaaggaaggcaaggcggacccctgttcctactcctgagtcctcgtccaagctccaggccttggatccgggtcgtcagcccgagagcgtcccctccccatgtccctcccaccaccaccctggggaccactgcctgcccactctggggccctctggatttggtccccagtagacttcccgagggccctcagtgtctgggggtctcagggctctgccccgccaggagctgggcatggagcttcctacgcgtgccgctcaggctgctgtggtgtttctcccaccctgccgtcaccgcgccgtagcacggcgtttccctgcacccaggcacaaaccagccgcctggcagagtgccacgtggcttcgcggaccagggatgcttcaggtgcagagggagctctgtgtgtcgggagcacctgcgcccaggcacaaaccagccgcctggcagagtgccacgtggcttcgcggaccacggatgcttcaggtgcagagggggctctgtgtgtcgggagcacctgcgcccaggcacaaaccagccgcctggcagagtgccacgtggcttcgcggaccagggatgcttcaggtgtagagggggctctgtgtgtcgggagcacctgcgcccaggcacaaaccagccgcctggcagagtgccacgtggcttcgccgtccagggatgcttcaggtgcagagggggctctgtgtgtcgggagcacctgcgcccaggcacaaaccagccgcctggcagagtgccacgtggcttggtggaccagggatacttcaggtgcagagggggctctgtgtgtcgggagcacctgcgcccaggcacaaactagccacctggcagagtgccacgtggcttcgccgtccagggatgcttcaggtgcagagggggctctgtgtgtcaggagcaggtgacatcacagcagaactgtcgtggcctttgctgtatgctgcagtgcctggaagagaaactcgctttatctgaggcctgagaagcccacgttcacagcacaagtatgtccacagcgatcacagtgttactggacgtgtgggaaaaaatgacgcaaacgtttcccctgactcttccaagttcagaggtggcccggctgccttgctctgcatgaggacagatgactctccgaaggggatttgtgttcaccttccagcatttcagaaaccaggaccccctttgggtcaccccaacgcccgtcccgagggcattttgtcccctttcgtgtctttcccagagaaaaaacagagtcccggagccaagttcttttcctcgttcctgcctctcctgtggaatttctagggtgtaggaataaaacgaggctttggaggttatctgtgggtttattttttcctgactgtagcgtgttaactggtccattaaaatctttaaaaagctttccacactgctatccctgttttttgttttttaataatggcataattttaaaaaataatctagtcttccccatattgtgattaaactcctcatttttctcattttgtaggagaaatttatctgttttgcaaaggagcagattcttcgatattcccccgagtgatagaaggcaaagttgaccagatccgagccagagtggagcgtaacgcagtggtgagagccgggctggggagggcctcgtggcggtcagctcccctgctgtcaggaaggaattccatgttccacaagttcctggctgggaatggcgtattgtattccttggggaatgtttagaaatcagctgggccagaggcagacagacaggcagcctcagccggcaccgaccccagggggcctccgatacccagccaggcacaggctgtccagccaggcacaggccatctcctccccagccttgcacagggttttattttcgggtgggtgccaggttggttgattgatgttttggggagtcagaattagcacgtttgtggttattgtattggagcaaaaagtctttgtgttgacgtttctagtgatttgcttcaaaacaaatcagcactttcgttttctgttgtgacatcacctgtttgggtttctttccccatctgggtcttaagcttgtatgataaggtttctttccaccacttgttgtatagcaccgcccagcagcccgcacacctgagcctcccactccgtgggtccggctttctgtctttggggctgctgcggtagggggccggcctgagtgtctctcacagcagggcctcccctccccgtcagacgcgctaaagccgggcaacacgtggctggggtggacacgctccctcctgtcagacaccttaactccgggtgatgcgtggctgggtggacatgctccctcctgtgagaggtcctaacgccgagcgacgcatggttgggtggacgtgctctctcccgtcagatgtcctaacgccgagtgacgcacggctgagtgcacatgctccctcctgtgagatgccctaaagctacactgtgcgtggctggggtggacgcactccctcctgtcagacgtcctaaagctgggtgacgcatggccgggtgggcgcgttccctcccatcagatgccctaacgttgggtgatgcgtggctgggtggacgcgctccctctgctccccacgtggctgctttgtcccacggtgtctgcacccttctcccgacaccaccctggggtcttctccctcactccagcccagggcagcacctcctctcacaccgaccttatcatcttttcatgaaaaagaaacagtaactgacaggctctcctcccagaggtccaaaatgacgctggccagagtggctacgcactggaaaacaagacttccaaggctggctctgcaccaaggaaggctgaaccgagagaaccttggactagaggtcgtggtactcagcgctcccttcactgaccatttaaatgtaaagcaatgtttgtcctcgctgtcagtcgcaacacttgattactgtagatgtcagagcattaagaattcctgccgatggacaggagccctttcgctcgcgagcccgtgcgtgcagcagccagagcctgtgaacttcgtggaatgctgtcgacgtgcggatcatcatctttacgttgctattaaaacagctcctggcactacaaagtagctgcgttggagccaacaggaatccataaatcagcagcaggttaaagattgttgaacttctctgtgagggatctggaaaatacatcactgacttccaccagccacagagctgcagggtgggagccgagcgggttcctctgagcagcacaagcgtcctgcgcttcgacacacaatgagcctcagtacaggggcgtgtgggggctcctgagggggcagctccatctgcagctcgctttccaatagcgcgaggctgtgctttgctgtgacgtggtcgccgtgccatgctgagcacacgatggctacaggtcacaggtgactggtcctccatggagggtcttcatggcctgagtaccaaatatcttccacctgctggatccccactgctgctgcccaggagagtaggcgcatggattatgtgaattgtgatgattgtaaagtccacttgctgcttgtttcagaaagtcttcttgagatgtaattgccatacattgatctatacatatttaaaatgcgagagcagcaagggcattgacacacgaacacacaggtggaggctttgcctgctgggaaggggacgcatccctcaccctagagactgtctcgcgccctcatactcccatccctgccaactcccactcgctggagaccaccgctccactcgccgtcactgcagattcgtgcccaccttctggagcttcctatcagcagaatcacaaaaggcggctgttgtatccggcgtctttcactcccataactgctgagactcggccgtgtgggcccgttcatttctgtcgtgaggaacagcagcactcgttcagttgccgagcactagcggtactagttcagcggccgctagtccaagtacctctagcggtactagtccaagtgccgggcactagcagtactaaccagtccagttgccgggtgttagtggtactaaccagtccagttgccgggtgttagtggtactaaccagtccagttgccgggcactaacagtactaatcagtccagttgccgactgctagcggtactagtccagttactgggcactagccatactaaccagtccagttgccgggcactagcagtactagtccaagtgccaggtatcagtggtactaatcagtccagttgccagccgctagcagtactagtccagttaccgggcactagccatactaaccagtccagttactgggcactggtggtacagaccagtccagttgccagccactagcggtactagtactagtccaagtgccgggcagtagcagtactaaccagtccagttgccaggcgctagcagtactaaccagtccagtttccaggcactagtgatactaaccagtccagttgccgggcactagcagtactaaccaatccagttgccagcactagcggtactattcagtccagttgccaggcactagtggttctaaccagtccagttgccggcactatcggtactaaccagtccagttgccagcactagcggtactattcagtccagttgccagcactagcggtactattcagtccagttgccaggcactagtggttctaaccagtccagttgccagcactagcggtactattcagtccagttgccaggcactagtggttctaaccagtccagttgccggcactagcggtactaaccagtccagttgctggcactagcggtactaaccagtccagttgccaggcactagtggttctaaccagtccagttaccaggcactagcggtactaaccagtccagttgccagcactagcggtactattcagtccagttaccaggcactagcggtactaaccagtccagttgctggcactagcggtactaaccagtccagttaccaggcactagcggtactaaccagtccagttgccggcactagcggtactaaccagtccagtttccaggcactagtgatactaaccagtccagttgccggcactagcagtactaaccagtccagttgccggcactagcagcactcgttcatttgccgggcactcgcagtgctagttctttctacggatggaccagtttcttgattcttccgcctgttggcagacattgggttgtttccagttggggctgttttggaagcagctgctgcgggccgcctgctgtgcgtgtctggggctgagccgatgtgtccttttctcctggggaccctcctgtcagagcgtcttcatttctctttccacagcttcccttttctggctgcttttgaggtgtttcgtgatgggatgccttggtggagtgatgctgtgtttctttgctcagccgtgttgagcatctcggatctgcggcgtttcatcaagtttaacatttttcagcaattattctacagatatttttcttccttgctccctttcagcagttccaggacccatgtactcaactgccggatgttgtctcaccgcttacaaaggcttttccctttaaggttttccacgtttctttagagacggtttctgttgccatgtcacgagtttttcccgtgcagcgtctaacctgtcagcaccccacgcaggacacccctctcctcaaacatcggagttttcatgtctagaaattccgccagcgtggttttgtatcctcatgcccctacttaacatggggcgtgtgtgataacgattgcggtgactgtttaaatcctcctcgctaacggatgggacgtgtgtgataacggtggcagtgactgtttaaatcctcctcgctaactgcacccctgctgccagctctggaccagccacagtgttgcacagtcccctcgtttggggcagggacggtgcccctgcgtgatggtggcctgtggccggatgcctgcctgtgggctttgttggatgctgggtatcgtggtcctcctggagatcttaaatcttgttctggggtgtggctgagttcctgggaacagtctgttcctttcaggccatgccttcgtgatgtccagcagacccacagcagtgcctgccccgggtggtgctccccagactgccaggccctgagcgctgtgcctggtgagtggccatgcctcctggcagcaggctgtcccaccctcctcctaatggcttgttgctggcctccaggagcttcctcacagttgcaggtgcttgaggggccgtccacagcctctggcatccactccatcctaggaactctggtgcttgttcccttgacacccaggtctgccccataactcagggaattcactggctccggctacgttcccctgcccgagcctcggcctggaagctctccgggtagtgagctgggcacttgcagggccccctcggttggcagcattttattttgaaataattacagatttaggagaagttaaaataagtagaaagacagtccagaggggcctgtgtgtccttcgagtccagttaatttctcctttcgctggctgtgcttgctgtcatatcgaagaaactgctatgaaatccaagatgatgaagatttgccaccactgtgtttttttctataagttttctagttttagctcttaaatgtaggagtgtaatccatgtttggctaatttttgcatctttcataaagtgagggtcctactttatttccctgcatgcagttatccagttttcccagcaccatttggtgaagactctcctctcccactgagtgatactgacactcttgctgaaaagcatttgattacggtacctggaggtttatttctgggctctctgttccatcccattttctctatgtctgtctttatcccagttcccgctgttttgattactgtcagtttctagcaggctttgaaaccaggatatgtgagtctttcaactttgttcttctgttataaaatggtttggctattctgaacctcttgagatttaataggaattttaggatgggctttttcatttgtgcagaaaatgccactgggggccaggtacggtggctcatacttgtaattccagcactttgggaggctgaggcataaggatcacttgaggccagaagtttgagaccagcctgggaaacatagcaagaccctgcctctacaaaacatacaaaaggaaaatcagccaggggtggaggcacacatctgtggtcctagctactaggcaggatgagatggaagggtcgcttgagcacagaagtttaaagcagtagtgagccgtgatggcaccactgcatgtttccacgggcaactgagtaagaccctgtctcaaaaaaagaaacggaggaagggcgggagggaagagccattgggatgttgataggatttcatttaatcagtagatcactttgggtagtgttgtcatcttaacaatccatgaacatgggatatctttccatttatttaggtattttataatttctttcagcaaactttggtatttttcagccttgagtcttttacctccttggttaaatttattcataagtattttacttttgttgatgctactgaagtggaatttttttttaatttccttttcatattgttcattggtagtgtatagaaatgccactagttttcgtgtgttgactttgtaccctgtgtctttgctgaattcagttagtggggagcacattcttcatggtcttctggatataggatcatgtcatctgcaaataggccttagaaaggcatcctttctaatgtggaaactttctttttctctttatagcctaatcctctcacttagagcatctaatactctgttgaatagaagtggcaaaagcaggcatccctgtcttgttcctgatcctacggaaaagctttcagtccttcaccatggagggtgatgttagctgtaggtttttcttttcttttttttgagacagagttttgctcttgtcgcccaggctggagtgcaatggcacgatctcggctcactgcaacctctgcctcctgggttcaagccattctcttgcctcagcctcccgagtaactgggattataggcatgcaccaccacgcctggctaatttttgtatttttagtagagatggggtttcaccacgttggccagtctggtcttgaattcctgacctcaggtgatctgcccacctcagcctcccaaagtgctgggattacaggcgtgagccatcatgccttgctggttttttcacttaagtggtttttaccacgttgaggaggtttcttctctccccagtttattaagtggttttatcaccaaaaggtgctggttttttttcagatgccttttctgcatcagttgagatgatcatgtgggatttatgtcatgtattgcattgactttcatatgttgactcacttttgcattcctggaataaaccccacttggtcgtggtgtatgatcctctatgtgccattggattcagtttgctagtattttgttgagcatatttgcatctatatttctaagggatattgttctacagttttcttgtagggtatttgtctggctttgttttatgtgctgtgtccagggttttcgtagtacttagcaggaggaatagagaaaagtatttctgttctgtgttaccacaagagaaagtccctgattgacttttaaaagcagcgacatatttatttccaaaagcttctgcttatcactcacagcaacctaagttctgggaccattttgggttattatcctgtaaaaccattttcttgttatgtaatttttctggtttcagactgaagctatatatcttgtatgttttattgcctcttaggaaaagtcagagaattcattctgcaattcgcatttatgtctccaatctgtaacttgatcaacaggtgcacaaaagatctaatttcaaccacttatttattcagcaaacgttgttgagttttggctgtgtgccagggattcagtggtgaagtcagacacagtgcccacagccagagaacccagtgcctaacaatagaggcaaacccgtgagcagaaagctgcaaggtcgtgtgctcagcaggaggtgaggctggggtggctgagcagcgtctgttcagtgctactttcctctgagacgggtccactggcttctcacttattcttgaccaggagacaatatctggaggatgggaaggaaggagttccagaatgttcctggagaacaggactcaggcacacatagaccctgtcttgtgttctgacttcttcaactccccctttcccaacttctggcttttgagagctcaagggccatgacagccgttgacccagtggcaattctgtccacaccagttaagaggtcggaactagtgataaatatgagccttccctgagagttaggagacgcttcatctcatagaacggaaaacattgtttcaactcttacaaaccagcattctgccggattttaaaatggttatttgggaggattatggttcttttactattatcagtagggctggggctgaaggagcagggaaaacggaaggggaacaccctagatgatcaggtgtgaacctctgtgacggtcgcgctcagcagccttgactgatggaatgaagaggttcatctgtaaaccgccccctgtgtggctgcttcagcctctgcccccattccttgtgtcttgctggtggcggctgcattctctctgtatggtaacatccagaatgatgatcacagtaaggaatttgtgattcttgatttcttttgttcctgtgcaaccaatgattttgataaataacctggcaggtttccttcattgtgaaagaacaacctaccttacaaacttcccacataaaacatgtttactttagaaatatcacttgatattacccataaaattacaaatgattatccttaaaaaaaaaaggttaaatttaactctgcatttgtcaaaataaaggaacaaattttatcttttgatagatgactctgatttctgttacttatttccaggctttctagtctgaaaatgctgtaatccataatgattcttggtatttaatgtagacttaaataattcacttgttgatgacttactcctttcaagatttggttggattataatctttctttctttgtttacttagtactgtaagttttgaaagggttacaattcttgggttagttagtctaatgagagaagggatactgggaaggccgtggagcgtaatatttcagcaagtgacaccttgaattcgtgctaaacgctgcattgtgttctgcaggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggtaaagtaaacgcatgcatcccgtcctgagagacaaactgggatgcaggccgacggcccagggcgtgtgagggcgagtggacgggagggaggccatccgcacagccgacggggcgtgtttgctgctcagggagaggctaggtgtcttgctacaccctggagtcatgtcaggaaggtcatgcctgggggatattttgttgtccatgaagaagatgcctgaaagcacactttcccaggaagtagtgaaaatagctttgtcatatcatattatgaacaggcaagatagaagggctcttacaaattctttcttctttttttttaagggatggcatcttggtgtgttgcccaggctggagtgcagtggcaccatcacaactcactgcagtctaaaactcctaggctcaagctgtcctcccttctcagcctcctgagtagctagaacttcaagcacataccaccatgcctggctaattttttatattttttgtagagataggatctcactatgttgcccaggctagtctcaaattcctggcctcaagcaatcctcccacctcagcctctgaaagtgctggaattgcaggcatgagcagtcatgcctgactgtaattactctttagaatggaatcaacaactaactctgttcctaaacttgttgctagttctttccaaatactggtattacttcttagatcattacatactcaatgtgtttatcattacttgaaaaaacttaatgaagtagaaaattacaaaaactaataatcatcataactggcaaaattaccaattacagattttcaggtacctctaaggcaagagctgccagtgtgccccagctccacaatggggactgaaagttgtttgaggctgaggccactaagaaacagtcgtctggtccacatggtgccttccgagctgagtgaaaggcatggatttcagtggtttgtaggaatggaagaaaaaaaatgccccaattgatgagaatgaagcagaaacttcagaaagttcactgggagtttatctcctagaagaggttaaaggcatcaagtttgaaagtctttaagatccatttcggtccaaaactgaaatccttatcactaaccctgcattttctgagcgtgttgaacaaatgttccttgagttctcgatctgaatggagtattaggcgaagtgggaagttttggtttggtggttttgtgttttgttttgaagtcactctcccctgttcagtccagagtaagtgcacagagcaccgtgtaaagaacgcgacttgcacgtgggaaggcttcagagcgcagggccacggccgccgaaaggctttgctgctgggggctgcgtccttgctctagtggccagtcactcacctgctgtctgtccaggagaagaggggtgtccgtaggatggtgtttgcctggggagcagctgggtcgatctttagaggccttggtggaggagcgtggggatgcctccggcagagcagatgggacagagcccctggggcggggggcaggttgacttgactggaatgggaatgtagaagagtggagagttaatgcctggttggcggggggggatctcagtggctttttcgtgatgatacttgcttataaattatttccttataatctccagtcagcaagtgcgaaacatctctgagcctcagcttccttttgaatcgaattgtagggccaggcccggtggagcacgcttgtaaacagggccaggcccggtggagcacgcttgtaatcctcgcaatttgggaggctgatgcaggaggattgattaaggccaggagtttgagcccagcctgggcaatatagtgagatcccatctcttgaatttttttttaattagtcaagcatggtagcaggcacctgttgtcctagctacttgggaggctgaggagggaggatcgcttgagcccaggagttggaggctgcggtgagctgagatcataccactgtaccctagcctgggcaacataaggcgttctctcgttctcttgctcgctctctttctctctctctatatatatatatatgcacacacacatatgtacatacacacacacacacatatatatatacacatacatacacacacataaaattacaggcttttttttcatctatagaatactatgattgtctgatcttgagacttttagctaggaagttcttcccaaaacctaaccagatccttccagttagaatttaaatccattcctttcatactttctagaagcatggcacgttacttcacacgaaagtagtctgaaacttagaaaaaatggaggccccaaagtgaggcagacatggtttgaccccagatctcccaaggagagggcagtggtctgactgctgtcggaagagccgcttacccccgacaccttctgcagcgtctgcaggctttgggttttccatatgtaaataggtgtggtgctagcgtccttactcgtgacatcatggtaagcatgaaagattgcacataggaagtgtcacacaggcctggcatgtggcaagcccatggcacctgttggccatagaatcactagtgttattctcagtattttatattatttagaggtacctggaccccaagtgggttctaagtgacaaacttagaacagtttatacaaaacaaaagacaatcaatattcctgaccaccttgagtccagatcccatctttccatggttgagacatttttggtggtggttataatttcctgaaaccctccccaggtagtgagtcccacctacacacaaaaccgccaggcttgtcagacgtcagtgacacaagacagccctttacttctcacatgtttgatccatgtttatctctctgctgttaggaagtgtttcgctgtgaaacactagttcagaccttcagaagctgcttcagtacttcgtggtgagatcatgagccacagtgtggagtgttttgattttgaggggctacgatattttgacagctttgcaagtttctgcagttccttatttggattcctgggtcagcactgacttttctctatgctgtgtttggttttgcctccctcaggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccgggtaggcagcgcgtccccgcccccacccccacactcccgcaaaaggggcttcagacccagtggccttcacctgcaagtcggggagccgcattgtctctactgggaattcggttctcccctggggcattaatgccagcttcttaggggtcaggtgaacactgggaacaaaacgggctgttttttccagcaattgtgatgtgtctttttcacatatgtgtgtgtatgtgtgtatgttcagtttcacactgccggctaacagatgcaaaaagacatgatggataaaatattttgagtgggataattctcatctgtttctgagacttaggggctctgcttcaggcaccttcaagcatctgctggaggaagtggagatattaataatgcatggttgttcgtctaagacgaagcagtacatgcccaagagttgtttttttcccaagaatattcagtagtttattcagatacattttatcgatgctgtccttactggtgttagatgcattatctgagattacatgttatttgaatcatttcagtttcattcatgtacataaagcgaaagcagctctctaatttacacaaatgttaagttattcataaatagcacagataattccctctacctgatctgcaatctgcagaactccttttagggattggagggttttttttgttgttttttgttttttgtttttgagatggagcctcaatctgtcgcccaggctggagtgcagtgatcttggctcactgtgacctccgcctcccaggttcaaacaattctcctgcctcagcttcccaagtagctgggattaaaagcgctcaccttttaatagagacagggtttcaccatgttggccaggctggttttgaactcctgacctcaggtgatccacccgccttggcctcccaaagtgctgggattacaggtgtgagccaccgcatccagccttcttgtcattttgaaacccagcaaagaggagattatgaccatgttctttccaacttaggtcatccaggcagaaacccaaggacttagctgtaaagactgtgaccaagaaggttgagagtaaagaccaaccaagatcttagaccacaagatgaacgccttcctgttgtttcaaaagtacagggacttaacgagtccacaaagagagtctgcacttgctttacctaaaataggaatgtttcataaaatacactcttaaatgtcgacaaaaggtgttatgttcaatactataaaaattgtattggtaaaacaagaaacactagtttcttaatcccatggatttgtagcatctgtcgatatccaaaaacaatacagtcttctaaaatctatagatttagtgattgagcaatctttctgactcacgtactctaacagactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcaggtgctgcccgcccgtcctcgatagctggtggtcagggcgtccaaaacactgaaaaccttccgttaggtctcaccgcctcagattgttaaacaatctagcagggtaccacctgttaaaaatagaagcaaccgtgatagagatttaaaacgcagatcttgttttgcttgtcgggccagcttctgtgattagtgggtgatgaccagtcagatgtatgacccttccagatgcagtggccaggacagctgccctggctgacttctgttaaaaaaaaaaaaaaaagctatctcaatcactcctgagaatctacactaaaggtgtaagggaagggagctgacattactgagcacctagtgtgtgcctcctacagatacgaatgcatttagtctcaaaataaccctctcagacaaatgagggcaccagctttacaaatgggaataatttgccgaaaaggctgcagatgggaaatgccacgaggattcaacttgtcttgtccatcaaactccaaacgtctcacgcggccatgttcttgtgggaaacgcacacctgaagttttttctttaaatagttttgaaagcactatggaatgtattgtaaacatggatgtctttctggtatcaggaagcctagaaaagttctgactttgttataccacattttagatatgataggccaatttctcttgaactgttcatgaataaatccatcattggtcagagcaaaccagtggttaaggtaaaatgcgtctcacacaaactctggaaaccaaggaggtgaaaagttgagcctttgtgcatgtgggtgcactaatctgtcaatttcactaaaaacacagaaccagggtcctcagaatgacgagcctagagcattcacagaccttccatgtgaggaagacggtttgatgtcctcctctccctcacatgcgtaactgcacataaaccttacagaattacttcccaaatggaacagcaactaaggatttgccattcgctcttcatgtattccatagtacttttttaagttctcaactggcttttgaaacatttcatacaaattaacttgtgtttcagtttcctatcttgaaacaagaaggcacccacgtttccccccatctcttcattcttacagcttgaactgttacatttaggcacatagatgggggggaaaagattataaagaaattgactaaaaacttggaaattatttttacataaaattgtcatatttgattttgcacgttacaaatttgaaaattaaaatagcattaggaatagtttatgtttagaaatagatgctttataccaaatagcttgaagtaccttggaatagtgatcttacagaatgcagggttcacatttgcccctgtatatttaaatatattttcccaggatttacacacttttccatatatttaagtagaggaatataacaataactacaagctacttcatatatctcacatctctactgccaaagtttgtctaccagccttttccagctcacgtcattttaatcatacctcatttcttttactttattttgttttgctttcaatatgaaaaaggttttatcctatatggagaaaacagacagaatgtcgtaaattacctctaagtagttaatttttttatttgcctaggctaacttttcatctttgttatttctgcctagtgaatgaataacctgttcagaagtgaaacagagaagataaattccgcatttctttcttttgcagattgttaaattaatcaaattttcaaaagagcacccaatcacgttagcaattggcgatggtgcaaatgatgtcagcatgattctggaagcgcacgtgggcataggtgagcttcgtccttgctgctggcacatcctggtggccaggtcaccccttcgctagacaaaggcccatggcagcacgcaggtgcattcaggacacccccgtcaccaccctcgtgtgtgaccgggaaggctcatgatgatggtttcatccgttcttctccccgtccctgccctgtgtgtggtgtgcagaaagcatttcttcagctccttcacctccgtcttctaggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataaggtaggagggtcgccgctccccctcacggtgttagcaacaggtcacgcacagggtggcacgacccttgtctgagccacttgatgccacaagaggtcattgatctccgaggagcagcaactgtcagaaaggaaggggtgaatctgattgcagtcatctcttgcttagctgtgactttgctttttacagtttccattacctacagtcaacccatgcccaaaaatatcaaacgcaaaattgcagaaataaacagttcctcaggtttaaattgcatgccattccgagcagcgtgatgaagtctcacgccgtcctgctgtctccttcctgggatgtggcttgtccctttgtccggtgtgccgatgctgtgtgtacactacctgcccctcagtcactctgtagctgtcttggtgatgaggttgacagatcacaagaagaagggtgaatatgacacaataatatattttaagaggaggagggagagaccaaattcatgtaactttgattacggtatattattatagttattctatgttttgttgttactctttcactgcacctactttataaattaaactttatcatgggtgtgtatgtatacgaacacacatacccatctagagcatagacagggttcaggaccatccgcagactctgcatccccccagggtctgggaatgtacccctgaggatgaggagggcctgccgtgccgcgggaggagacccccagcccttttctccccccacagaattgagtgtggaaccagtgagaacctttcaggtggaaatgtttgaggaaggattccttattcactgtgcagttcgattctttcccgtttatactgatacctgcattgccttcttgtttctcttggagctgacaaatttcctctatacgttgtctgtcctgagtggccaaaacgtggtcacatgtgcatttcagttgcccctgaaataagagaaagctttctagaacccattagtgctgttctgccgcacgctgggtgcacgtggatccctcctcccatgtggggtgggccacgtcggtaggtggcggctgcctccctctgtcccgtcaccgaactaacagttatgccttgcctttcagaacgtctgcttcatcttccctcagtttttataccagttcttctgtgggttttcacaacaggtcagtcctagggtcttcagggacaggctgtctgagccttcttttccttcccgcagtgggtggctgctgtggggaggggagacttgggaatgagcagcactccccggcaccacgagggagccagggtgcccagcagcaggcgggggtgaagggtcgggcctggggaggggggccacggagctgaggagttgccgtcctggaggccccttgttccatgtcttctgaaactgccgtggccctgagatgcgggccagtgatgatgtggtctcctcagggcccagcagtgctgggctgggcatcctgatgccactgcaagaattaactccaactcgaggtccttgtggacatgggccaccccggtgcctggcacgttaacacatgcaacgtgcccataggggaagaagacagttcccatccgggaggggtgaaggactccccgggcatctgccctagatggacacctccttctgtcacatgtgtgctcagtggttggcgggccagctgccttcatgggaagtgactgcgaccagagtcactgaagcttgaagatggcaatcagaattgcaaatgttttctgtgacttttttccttttttttttttttcttgaagtttgtgctgatagaatgggatgagtcagtgttaggctttttgccagctgtgactttcatcctgaaatcacagttgatatcacagaccctagtttatattgttaagctttgaaaagcgctctggtctttctatgcatttcagaaagaaaatatatttaatcaaaagatccaaaaagtttgtaacaatgcactgaggtgccacttcttgtgactttcctcttacagactttgtacgacaccgcgtatctgaccctctacaacatcagcttcacctccctccccatcctcctgtacagcctcatggagcagcatgttggcattgacgtgctcaagagagacccgaccctgtacaggtaccatcctccaaacagcctctcctgagagcagagagagtaactaggcagcactctggcagttccttccaatagccacctggcagacctcagttgagggccagaagcattcggcatctgctgatattcttgcttgatcaggagcttgtttaaactggaagcaacatagctcaaatggagattcttcaagtcttgctggatggtttatgctgcatttggaacatctgtgtggagccagtttgcactttcctgtgctttctgacagtcctgagggagctggggtacaagcgtcttcctcgttgtgaccctagggaatctgtggcctaagttatcctttaaaaccatgtgtgttccattcagtgagaaaaaacaaaaattaacagctctggtttcagggtgtcttttctccccgttattttttaaaaataatatggaagagatatttttctgctatttcagaaatgccccccaaggtctctggcagattcaatatgttactgttttccatggtcttttaaattgtattagtccattttcatcctgctgtgaagacatacctgagactgggtaatttatgaaggaaggaggtttaatggactcacagttccacatggctggggaggcctcacaatcatggcggaaggcatgaggagcaaaggcacgtcttacatggtggcagacaggagagcgtgtgcaggagaactttcctttataaaaccatcagatatcgtgagacttagtcactattacgagaacaacatgggaaaaaaccacccccatgactcaatcactgcccaccaggtccctcccatgatgcgtggggatcataggtgctacaattcaagacgagatttgggtgaggacacagccaaaccctatcataaattaaaattttatttttcagataattttacatccatatgcagttgtaagaaataatagattctgtgggccctgatcccatgtcccttagtggtgacacgcaagaaactgcagtccagcatcacatccagtgtactgatgttggtgccgttcacccgttcccttattcagatcacccagctttccctgcacttacgtacatgtgtgtacatgacacgtgtatgtgtgtgttcaattctgtgcagtcttctcacatgcgtgtttcctgcatccaccaccatagccaagaccactcacttccctgcctgggattctgcaggaatccgtgcatcggcctcactgccctcatcagaatatttagccattctgtgggatcttgacggcttggatccaaaagtaatcactgtaggtgattaaggacgatgataaaaaggcaaacttctgagttggttgtacatctttaataaatctaaagaaaatgggaataaatctaagaaaatgggagaagatatactgttctagacatgtgtctgaaaggaatcctgcaaattctgtcttattgaacaggcatctttaataaatctaaagaaaatgggaataaatctaagaaaatgggagaagatatactgttctagacatgtgtctgaaaggaatcctgcaaattctgtcttattgaacaggcataaggtgtcacgtcaggcgtaaggtgtcacagcaggcgtaaggcgtcacgtcaggcgtaaggtgtcacagcaggcgtaaggcatcacgtcaggcgtaaggcgtcacgtcaggcgtaaggtgtcacaagctcggtgaacgtcaggggtgtgccttgtgttctctgttcgttgctttcagaagcagcagcatgtggcagcatctctgtgcctatgacgatattgcagtgaatatgagagagaaaatatctgagcaaaagttagccaaggacatgagtgggtagtgaaatgctggttgtgatgaacatgccacatttgtggccagagcacaaacttgatgtttactggccgtgcacatcttatcccatgaagacaacgtccagggatggccaccccagagcctgggggaggtgccgggccctgattctcgaggacacacgctgtgcacctttctcctcaccagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcaggtcagtacagagctcgattgcgctgacttagctgcttaggaataaagcctcccaagcccatatgatgattttgccaaagcagaattcagtgcagcccatgcagcttcccagcggggtccatcaccacctgcgcagtaattcagtgcaggccacgcagcttcccagcggggtccatcaccacatgtgccgtaattcagtgcagcccgtgcagcttcccagcagggtccatcaccacctgcgcagtaattcagtgcagcccatgcagtttcccagcggggtccatcaccacgtgcacagtaattcagtgcagcccatgcagcttcccagcggggtccatcaccacctgcgcagtaattcagtgcaggccacgcagcttcccagcgggatccatcaccacgtgcacagtaattgagtgcagcccatgcagcttcccagcggggtccatcaccacctgtgcagtagttcagtgcggcccatgcagcttcccagcagggtccatcaccacctgcacagtaattcagcgtagcacatgcagtttcccagcggggtccatcaccacctgcacagtaattcagtgcagcccatgcagcttcccagcggggtccatcaccacctgcacagtaattcagtgcagcccatgcagcttcccagcggggtccatcaccacctgcgcagtaattcagtgcaaaccatgcagcttcccagcggggtccatcaccacctgcgcagtaattcagtgcagcccatgcagcttcccagcggggtccatcaccacctgcgcagtaattcagtgcggcccatgcagcttcccagcggggtccatcaccacctgcgcagtaattcagtgcaggccctgcagcttcccagcggggtccatcaccacctgcgcagtaattcagtgcagcccatgcagcttcccagcggggtccatcaccacgtgcgcaataattcagcatagcacgtgcagcttcccagcgggatccatcaccacatgggcagtaattcagtgcggcccatgcagcttctcagcggggtccatcaccacctgcacagtaattcagtgcagcccatgcagcttcccagcgggatccatcaccacctgcgcagtaattcagtgcaggcctgcgcagcttcccagcggggtccatcaccacctgcgcagtaattcagtgcagcccatgcagcttctcagcagggtccatcaccacctgcacagtaattcagtgcaggccatgcagcttctcagcggggtccatcaccacctgcgcagtaattcagtgcggcccatgcagcttcccagcggggtccatcaccacctgcgcagtaattcagtgcagcacgtgcagcttcccagcggggtccatcaccacctgcgcagtaattcagtgcggcccatgcagcttcccagcggggtccatcaccacgtgcacagtaattcagtgcagcacgtgcagcttctcagcagggtccatcaccacctgcacagtaattcagtgcaggccatgcagcttctcagcggggtccatcaccacctgcgcagtaattcagtgcagcacgtgcagcttcccagcggggtccatcaccacctgcgcagtaattcagtgcagcacgtgcagcttcccagcggggtccatcaccacatgggcagtaattcagtgcggcccatgcagcttcccagcggggtccatcaccacctgcgcagtaattcagtgcggcccatgcagcttcccagcggggtccatcaccacatgggcagtaattcagtgcaggccatgcagcttcccagcggggatcatcaccacgtgcgccataattcagcgtagcgcgtgcagcttcccagcgggatccatcaccacatgggcagtaattcagtgcagcccatgcagcttcccagcggggtccatcaccacatgcacagtaattcagtgcagcccgtgcagcttcccagcggggtccatcaccacctgcgcagtaattcagtgcggcccatgcagcttcccagcggggtccatcaccacctgcacagtaattcagtgcggcccatacagcttcccagcggggtccatcaccacatgggcagtaattcagtgcggcccatgcagcttcccagcggggtccatcaccacctgcgcagtaattcagtgcagcacgtgcagcttcccagcggggtccatcaccacctgcacagtaattcagtgcggcccatgcagcttctcagcggggtccatcaccacctgcgcagtaattcagtgcagcccatgcagcttcccagcgggatccatcaccacctgcgcagtaattcagtgcaggcctgcgcagcttcccagcggggtccatcaccacctgcgcagtaattcagtgcggcccatgcagcttctcagcagggtccatcaccacctgcacagtaattcagtgcagcccgcgcagcttcccagtggggaccatcaccacgtgcgcaataattcagcgtagcacgtgcagcttcccagcgggatccatcaccacatgggcagtaattcagtgcagcccatgcagcttcccagcggggtccatcaccacctgcgcagtaattcagtgcaggcccgcgcagcttcccagcggggtccatcaccacctgcgcagtaattcagtgcagcacgtgcagcttcccagcgggatccatcaccacatgggcagtaattcagtgcggcccatgcagcttcccagcggggtccatcaccacctgcgcagtaattcagtgcagcccgtgcagcttcccagcggggtccatcaccacatgtgcagtaattcagtgcaggccatgcagcttctcagcggggtccatcaccacatgtgcagtaattcagtgcaggccatgcagcttctcagcggggtccatcaccacatgtgcatagctctgggtcactttaaagatcgcattacctgagtgctcagtgttgctgtaaggaaatgtcctgctgaagtttttttttgtttttttgttgttgttgttgagacggagtctcgctctgttgcccaggttggagtgcaatggcgcagtcttggctcactgcaagctccacctcctgggttcacgccattctcctgcctcagcttcccaagtagctgggactacaggcgcccgccaccacgcctggctgactttttgaatttttagtagagacggggttttaccgtgttagccaggatggtctccatctcctgacctcaggtgatctgcccgccttggcctcccgaagtgctgggattacaggcgtgagccaccatgcacggccagcctgctgaggttttcagactttatctctgtaactaacagttcaccatcagtttgttacctagtggtaccattataccatttagacattgcatttttgatgtgggaatgaattccacgttgagcccgtgttagatttccccgagtaccatacttagtcgtcttcctctgtgatgagtagatttgtagttttctagcagacattcactctctggttgtttgcctaacccctgggggtttgttttatttgtatcttgcttttttctttttgccactggcgtcccttcccaccctcagataatgactaccaacacacatatggtaagacaatcatgggtttgtcgtttctctgtgtttttggagtgcattacaaatgaaatatttctcgaaaatattttcaaacgtgaattcctgtgtgctttgtcggtagaaacgctgttagccgctgctgccccacacaccccagagctagctctgtgttagaagggtgtgtgcgcctcctgacgcacatccttgctgtgttccctcggttgccatgtcagggtggcccattgagccagggatgttttccgaattgactggattcatgggagcttccctcgattttaaattaaaggcagcacaggcatgtgtgggaggcccggtggggccctgtgcttcctgagagagccacaccaggcattcggtagatgtcagagaccatccctgcttaaatgcctcaggtatttaactagccgtacaagcagacaccagcgctgacctcggagaaagtccctcttcagcagccccttctgggtgacttctaaacagaaatcggcttcgttccttgtttagcctgacctctctctccctgtgtgtttgtccctcagactgctgggttcaaacacaaaagtcctgctatgtgtcctgtgcaccatttacctgctttagtcgttttcattcctctttactaaacactgctgttatccttcgtcatcacttaaatcagtttttaccaggtctatcttgagaaccaattcaaatattatttcactgttttaaaagctttaagttttctagaacttattctttgtcttcatttattttaattgaataattcctgaatgccaccaggccatgaacgtcatcaaacagagctacctgttgattcttttgtatcttttatgagattttcttccgagttgggcttacgtaagcatctcgcgtagcccttaagagagaactaagaggtagtgtcctgagcactgagattccaggctcctggcggctgccaatggcaatagcaagtcccctttttcccacacttgattttccagttttctctcacaaacaccaccctggttcactacaaccaccctatcagctggacgttcagatcatgtgaaagctgaggaaagagaagttcggacagactagacaccctgtgcggtgtcagctcccgagaggcagggcctgggtcatacccggacgtccggctccagacttcatggtgttgcccagtgcggcctctgggttgctctagttccaaatttcagcgtgaatgtgaacgtgcctcccaagagcccccggagatggacttcaggggcaaggacacgggcgccactgtcctaggagggcagcccggctgtgctcctgaatgaggtgctggcaacgcagtgccaggggcttctctcagccttcctggcagggtctctgcagcgtctccgccttctcggatccctggacccctggcgtgtccgcagtcagctgcacctggtggtcagtgggcactgtggctctgctgccttcctgggatccgaggatttctactagctcctgtttcctggtctcttccggctgtaccctccagcccctggctatgtcctggaaggtaccttgagcccccacggaacccgcgtgcagccccggggtgatgccagcactcagggaacttgggggcagtcctagtggctgacagccctcttggtccttacgtagcaatttggggttggggtgctcacccctgagaatctcccttccaaccaggatactcccaacggggttacagttcagaggccctctgggattgattgttcttgggtgagagctactttgttttaaagacctaaattattctataggaatatctatagatcctgtgtaggattggaggaacaatagaattatggacatctctttcaaaagttcaccaatggagcattttctgcactgacatcgtaagccatagtaacttctcattttgatgccacaaatgagaatgcgaagacaacagttatttgttgaacagcaagacattcctaagtgaacggttaaaagctcggaacgtgctttgatagacgtaggatgcgatgagagcagctgaaacacgagcggtccgcgtatgggccaggtgggaggcagagggatctgcacagggaggggaggcagtggatgccactcatgaccgtgaccttgagaaggcgcaagttatgctggccgtggatgtttttatacatcagagttaaatgggtctggtctgaggactttttgagcagaaagcttctataggaatacccattctcaaaggagggaggaagtgggggcatggggcttagcctgcagtggtggagggtggccagccccagaggcagatctgctgaaggagtgaggctttcgcactggtcaggttcttggctgagatgtgcctgtcacatgaggacagggttccacagaaatcagaaacaggagcttcactggggatggcgttgatgtcacttggaagaaaagggtccctgtgaaaagccctttgaaaaaggagattggtatcccagggatgcctgccacccccagaatctgatggaaataacgaccagcaattgtagtaataaactatccgcacatgttagtccattttcacatggctctgaagagctacctgagacagggtgatttaggaagaaaagaggtttaatcgagccacagttctgcaggctgcataggaagcatcgctggggaggcctcaggaaacttacaatcatggcggaaggcaaaggggaagcaaggcccttctttacaaggctgcaggagagagagagcaaaggggaaaatgctacacactttgaaacaaccagatctcatgagaactcactcgcccaccgtcaacgagatctgcaaggaggacgtccatgattcagtcacctcccaccaggctctccctccaacacacggggattataatttgagatgagatttgggtgaggacacaaagccaaaccacatcatggcagttcacctgggggccccacttcaggccaccaagggaataagagggctttccagagatgcgtttcaggatagctccacagtggactagcttccaaaggacgtggacacaggttagtaatgggtcagcgtttctcaggggccctgaccaaggtgcctgattctggattcacgatagctgtgctttgttcctcacctataaagcttacagctgtggcccatgtgctctgcaggaccaggcatcctgaggcctaactccttatcccagttctgccattaccccctaaacccagggagccccagctgggagcttagaaaggcagtttctcggctcacagcagggagaggggacagtgaggaggccgtgtgagttgactgcagttatcacctgtggcgctgttggtgacacacactgcttcacagggcacccttgagttcatgtcttgctgccatctaactctttcagagttctgtgttgggatggccaaggtgaggcctgggggaggaagaggagagctgggcagcgtcaggggcttttcctccaggcccagctgatgtggttgtctgggtgcaaagccgccctcagctgctgtggaggcaccacttggctgaaagcatcagcttccagttacagcacagcagcctcccgccctccagcaccttgctggccacatgtgcttgtaggctgctgccaagccacagctgttcctagaggcatgatattttcctgccccagaagttaagccacaaagagacggcactttttggtgagtgtgaaacaggcttctcacccgggctctgctgacattggggccagatgtacatcctcgtgggccactgtcgtgtgcactcagcagcccctccacccccccatccaaagctagcagaccccacgccccagaaatgtctccaccacggccaggtgtccctgggggcaaggctgccccagccgagaaccacaagcatgtgtagatctgagtgacactgtaggccaggcatttccaagccagaaggaggaggcccacttctgatcacaatgaggaagtgagggaaaaactgaaggatgtgttgatgggggcccctaagaagcggtgttcactacaaaaggtcctaacacttttttctataatctacaaatgagatgttatcctgttatcccactgaccatgtgggaggactgtagcccacaccctccctcagctaaatcaaggggtatggtgatgggtgtgttgttttggttgaaactgaattctgaagaacagccatttgtattccagctttttaagagacagagtctgtgctctgtcgcccacgttggagtgtagtggcgtgatctctgctcactgcaacctccgcctcccgggctcaagcaattctcctgcctcagcctccctagtggctgagattacaggcaggcgccgctacgcccggctaatgtttgtattcttagtagagacggggtttcaccatgttggccaggctggtctcaaactcttgacctcatgatccgcccacctcggcctcccaaagcgctgggattacaggcatgagccaccacacccggcccgctttttaattctttataaaataaaattccctgcgaggtgcagttcatggaatccgataaactagaaatcgtctgggccacagcgcaggagcgtcccaaaggaaagcaggttctcccgaaacaagtttccagtcgggggttttccccaaggcggggggtggtctgggcagcagccctttctggcctgtgcctcgtgcggtagagaggcgtgctgtcctcacgggtcgggcacgcggtcctcacgggtgtgtctgtgtctgtgctgcgttgccagctggcagctcgtgggtcccactgaccttccctcctccacggccacctgggcaccactgctggcggatctgtggttctggccgcacgcggggcagcctctgtccagccctgtcctgtctgccggcttgtcttctctgtcctgagggaggttccccgagggaagcccccaggcttccccctctgcatgggtgcctggggtgtttcctctgcatttactcgcagaacgttcccgccgctgttcttcaacagcaggcaggagtctgagctgagttcagaagggaacagacacagtctgtgagtttgttcctgaaacccgtggaatgtagctgggtactcaggcaactgtcttttctacgtaaaacacaaaacagaaaaaggaggtttgcgtgtacccgagtttgcattatggatatttaaatgccagctgtgagggagtttttgtgctcagtttgagaccttgggacgtctgttgtggctgagagcattgagcagggccagcgtcaggagcgggcagcaagttgcagataggcaggctctgagcccatcaccaagccacagaactggtggtgggagatgcagccgggaaatgggggcgtcctgccgtgctctggggagttgctgcatcttcttttacgggataataagaaaatatagtgcttatatctttggggtttgaagtgttggcacacaagaaaaatgaggtgtattttctaaaactcttgattgtgaaagagaaaaaaaaatacataaaaacgagatgacttggactattttccccaaacagatatttggaaactggacgtttggaacgctggtattcaccgtgatggtgttcacagttacactaaaggtaagtggtctcgcgctcacgttcctcccccagccacagtgaacccctgcagtgtaggcctcacgcgctctgagctctctgaattataactctgtactgaggctggaagccactctccacccagccttggctggctcctggggcacccctgggcatccttgtcctgctgtttagacaagtaatgcacagccactcagcacacccggccaccccatgtgcaaaccccagagctacaccggaggtaacctcgggagcaagctgcttctttgtgaaagaattcaggctagaattgttttcagtggcaagtagccctccccccagcgccatcaaaatacactttaattgaaacaaattaatgtattttgaaaaatttcactctttaaagttcagtgaaattatatacagaatatatcattatgaaatctcaaaacctatcagactgagtcttaaaaagtgataccaaaacattcctaaggtgattttcttagatagtgatgtaaacaacacctgactctaaagtaactttctggccaggcatagtggctcacacctgtagttccaacactttgggaggccaaggtggatggatcacctgaggtcagcagttcgagaccagcctggccaacatggcaaaaccccatctttactaaaaacacaaaaagtagccgggcatggtggcacgcgcctgtaatcccagctacttgggaggctgaggcacgagaatcgcttgaacccgggaggtggaggttgcagtgagccaagatcgcaccactgcactccagcctgggcgacagagcgagactgtctcaaaaaaattttaagaagtaactttcttcagtagagacataaagaacaccttaatctgaatgactttcttcggtgacgatataaacaacaccttggtctgtggcccgcatgctgccatctgggaaatacatccatggctcccttacctaggacccagggctgtggcgtccccacattcttcctctccactcacactgtgaggtgtggctttgtcttcctgagcagtgtgaggtgtggctttgtcttcctgagcagtgtgagctgtggctttgtctcccgaacggtgtgaggtgtggctttgtcttcctgagcggtgtgaggtgtggctttgtcttcctgagcggtgtgaggtgtggctttgtcttcctgagcggtgtgaggtgtggctttgtcttcctgagcggtgtgaggtgtggctttgtcttctggagcggtgtgaggtgtggctttgtcttcctgagtggtgtgaggtgtggctttgtctccttaatggtgtgaggtgtggctttgtcttcctgaacggtgtgaggtgtggctttgtcttcctgagtggtgtgaggtgtggctttgtcttcctgagcggtgtgaggtgtggctttgtcttcctgagtggtgtgaggtgtggctttgtctccttaatggtgtgaggtgtggctttgtcttcctgagcggtgtgaggtgtggctttgtcttcctgaacagtgtgaggtgtggctttgtcttcctgagcggtgtgaggtgtggctttgtcttcctgagcggtgtgaggtgtggctttgtcttcctgagcggtgtgaggtgtggctttgtcttcctgagccgtgttttgcaggcattgagtcgtcattgctgggtcttgcgtttggtttagtttctcgtcaccccccggctctctgtcctgcccatcacgatcattctcactgctcagatgacaccgttaactgcccttttttttttccttttagcttgcattggacacacactactggacttggatcaaccattttgtcatctgggggtcgctgctgttctacgttgtcttttcgcttctctggggaggagtgatctggtaaatatctgataagtagctgataatctgataaatatcatgtggttgttatttttttatcaagggttgaagacacattttccgtgcggccctgttggttggggcaagtgtttgttgaatggctgctgtgtgctgggtgtcgtggggtcctgggatacagtcgggggcaagacaccggggggttcctgctccggtgacttgcatcttccgggggagaaagacgctaactgataacagcttgtgacgagttatacggaggaacagaccaggattccgcaccaggggacccatgtcagattgaaaggccagaggtgacttttcagaaacagtcatttgaaacctggaagaagagcgccatcatcacagcaagtcccagctggtaaccgcctcccacaacgaggcactggccaggcattcgacaggtcctgtctcactccatcctcacgccccgcagcaagatggggcccaggcatggtggggctggaccttgcccgcagcagcctgactcatcggggagcctctggtttgggggagagcagcaggcacgcaggcccgggcgggaggaggtcctccgtgagtgggagccgtggccagcggagaggggcccggaccaggctgcagagcaggcatggtggcctcctggaccgccggccgtgaggatcctggctcgaggctgtcgtggtcagtcgaggcagagcacagcagagttgagtggctcttttaaaaaccccacggtggctgcgtgttgagctggtgagagcgacataggcagggtggtcagtctagagactgtcgctgtaagccaggaaacgacgctgagtggtatgggcccagggccaggtcccagtctcagccccagcgcagcagcctctgccacagccctctgcagacctggggtcagtagccggcctagggaaagccagcaacccactcaggatccctcagggcccctgacctgggcgggactctcagcccaggaagagtccctccggattctctcgttcagccagcggcccctggtggccccaagttgcattacacagtctcagagatgacagcccagcttggagggtgtcaggcaccctgtcagccccagagaaacctgcttagctctagagagcccagcccggctctggagagcccggccattctaacagccctgaaggcgatggctctgtaagaggaagattccatcccaaacctctctgaccagctcctgggctttgtagccaaggagccacagcccgtcagccttggtagaaccacagcctctcacattgtttcctaaaacattgaccccacgtctttgatgtgctgggagctcaccatgtcaccaccgcttggtgatgagaccccatcctcctgcccgccaccagcaccacgtgggtgcccccagccccatcccaggtctgccagcagctgcgtgtccctcccgttacccaccatgccctgcttccgtttccctcctgttgtccacacaccagtttcactgtgcttcctggagctggggccctatctctgtgtctctgccaccatccgtagtgcctgggatgtgaaaggcgatcaggaaacgttaccggaaggcacgtatagacgtggacctgtgggctcgggctggctgcgggtcactggtccctgcatccttgccagcctccctcatggaggctgacgcagacgtctttgaatcatcctctttctggggagagaagtcattgcttgctctgtactgacgaccagtgctcgggacgtccttcccatccgagacttcaagatagaaaaacatccctatttcaatccctttgtgttttgttttttgttttttttttttttgcttctgtgaaactgaacttcagagacttctatgtcccatttgagatgacttcatagaattccttctcccgttcctcttaccccagcattaccgggaggttcagtgttcattttttatatgataaattcagagcaggctccgtggcttgccaagcaactctcactgacaaaagtgtaaactccctgaacagacggcctctccagtgagtagagaggccagccccagggagtacatgcctcaccagcggcttctcttccctgcccctcaggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccaggtacggagtgtccccagccggggcgggggtgcctcagggccctggccttaggattgggagatgaccgttttgaaagacagtgtgaaaggtttggatttcatgaaacgtgatcagttcaggtatcactaatgagtgtcctgacggtgcatgatgttaaacatcaggtacatttgcgatgaccgatgtctaattttatgtttcaacctaaacagtcatctgaaatgagacacaaataagagaaaaaagactgatgcaaaaggcaaattatttcatgtaaatggaaaccttttttaaaattaatcattactttaaaaggttgaattacataatttttaaggatggtaaatctggctggaaacggtagcatctgtatcaggaaatgctggtattggtggagctgcttattttacacactcccaagttttaggcacaagcagaattctgggtccagggaagacgtgacgatgccgagtgtccccccaggtgcagggtttggcaggtgtgaggacttagctcccggtcccccatccttttcagcagctggcctctgccttcaagctcaaccctaaatcagaggcagtgaccacgacccacctctgctgctttactgggaagcctgcctgtcctcagagggccgctgcacctgtcacggtccctcaggactctattaacaatgcaagttttcaagtttcatccccgaaatttccaatcactccttgaggtggagccctggactgggcagtgctgaagcccaatggggaaatgaggggtgggggcccctggcagtggctgctcctgcagggtgtgaggctccccaggtgggaggaagacggggagtgagtgggggccggggccccagccctgactcactcacgtagctcagacacccgggggctggctcccagcggtgctgctgtgctgggagggaagacaggttgccctcccttggggggcacagcctcacccaccacccacctccaacaatcagaatgggaccctggcttgagagctttcttgggacattggtgccgatttgaaatgttgaaaccgatgccaccagttcccggcactccctccttcatgcctcctgccacagtttgtaaaatcagagcgagcaaaactcgtggtgaagagactgcctctcaatgtagtgaaaatgtccacacacagctccactgactcgggggccacaggcaggagaaacgcagcagaacgtgccagttggctgcttataagaaggtcccactgaggggcctctgtgcaggaggggagacagtgggagcaggagccggggccctggctgagactccgcggcccccagtgcttcaggggaaactcaccggccccaagcagccactcactgcccagccctgcctgtggcccgagaagcagctgtccagtggtggttttctctaagcacggtccttggttactgagctctttagctgtgcagttccacagcgggcacacgtgttcatgacagggctctgtgcatgggacacgtgttcataaccacatcccatacatggggacgtggcagacacacatgtaacaaggacatcaggcacagaagagacagcagggctgggggtctgaccccgagagagagcaggtgcagcttgggggtgtctgctgggcccctagctgtggccacagtggtgtggcttggggtttgcacgagtctcagccccacctggcccctgggtgcatgtggctgcagaggtgcttggtcaaagatgcctgagcaggcaggagttgaactcggggggttaggagggcctctccccgcaggagtctgggctcttccatgcactgtgcacgcagcctccagagtcggggctgccgagggccacgcccccggatgtgtctgaccacaggccctctgctctgcaactcatctccaggatgggtgggcactttgggaatgccagtgaggaccctccccgtcccaccctttgtttagaagcccctgtattgctgtgggtctctgcgtcccacaagagccccgggaatgcttatgaacagctacacagcgggacctgcagaaggcataaagcagggggtgggaggggctggcgggtcacggtggggggcaccagtgtccgcccagagtgaccagaagaacttgcacgtggtggcgagcctctgactaactcagctctgtctcttgtttctctttccttcccatttccttccgtcttccgaccgctttgcctaaatcctcacaccttgttcacacacccctgtgtgcgtggccgctgacctcgggactaagactaagagccagtgcctttctgtcgagcagtcaaccatctttatgctttctcagacttccagcagcctgagtttctgatggaacaaggtgatgctcctctgccttccacgcacctgggatggtagacacggggcagcagggccatgcccatcaccagagccctgagtccacgtgctctgacgcagcgtccaccaggcgctgggtacagcagcctcacgtcgggaagtcccgccaccacttacaccttctcatgcacagactgatcatgggctgtgctttccatcagtcacagttaaccagggtttctccctcagcgtccgtgcagcctcagaacccacctgtgtgagggttcagacacagctgacagcggagagctggccacatgacccctcacacaggtgtcagaggggttcctaagcaggaaggtgtgagagtttgcaattcacaggtcatccaggctctgagctcacacacccttccctctgcagcctgtagagcgtggatcacaaggcctcctccctcacgcacccacttctgtgcccattctgcagctggaaagactgagggcagctaggataacacggtttgctcaggacccatgcacatttcagaaaaggggagccaggctgagccacacaactggagacaaagaggggacggaagtgtttggtgtcaaatgtttgaccaaattccctttttactgttttttaaatgaaaacctcattgtttttcaaaaaagccttctattaataatttgctttaaaaatgacgaccttggcctttctgggcaatgtagaggcgttcacacgccatttttctgcggtggtgtccatgataagagccgagattgcaggggcctgcacgccgtcctgaagtcgcgttctgtcttttagccgtgtgctcctgcaccaaataccgccttcacgcatgcctccaaatcagtgatgctttgaaaatgcatacttggtattactgttttaccaaatgcagcttagaaaaatgcccaaagcagaaaaaggcttcttttccctttaataacatcatcttctatatattttaaacaggatttttaactgacaaaatggtccttttttaagtccaagcaattaatcagaatcaacagttttctaatttagtgtcatcagaatttgttagattaaattgcagaatttcatctcaccatttctgtacttgaagacatttaggatgaaattattaggaacattttaatgactcataagaggtccttaagaaactgattaaatcatgccaactctgagctaaaaataagcattctaacgattcatgtagtttgttgagagctgatttgcttctgagcatgtacggaagctgagcccggctgcgtagagacagtggcacggagtttctcctgccccctgcgaggccttgggccccggcatgacccccacagacagggccggcgtccacacttgaacagaaagcgcctgcagccagcacatgcccggcgcacacgggaacacgccgtggcgccgagaccacctgcgttctgcaaaactttggaggaataaacgtgtcactagtcctcacgtggggcatatgttacttccagtggatggctttcttttaacctgttcctacggaaaagaaaagcatcacaggcctcagatgtatatgttatatatgtgcgatttgcacatatatgcccgtgctggcatctctgcgtatctgcatgcagttcacttctccgtcactgtccccaggaagggtggcagcctcatcctctgtttcctacttctcctcacctgggcgtttgcccattcagacgtgcaattgtgcaattccaagcccgcagttcttcagctcctgtgcttcccttattccttgaataaggctgggctacaagatctcagtggagttctgtgagcacgctggactcaggaaagtccgtcgcagggccctggtagagcggttactggagctcgctgtctgccgtggaagtgggcgtgtggctgaacgtgtggcttcaggattccagcggtgcctggtagaccttccagccgagggacctcagaccctctgcctcccgcgggtgcatggcccgtccctgagcctgtcgctgtctcagttctgggctcgggcccctcatgggagcggccctgctgggacagtgttttcccaagacgccccaagccctcgccctggcagctccatgacaccccatgcagactccaacaggggcttcgagcctcttcctgctggggtcccacggatggtgcaggcagaggcccgagcactcctggtggccccgtgtggcccacgtcgctcagtatctttcctcgccttgcagaggggtgtgaagcacaaggctccagtccaggccgcacagagcagcgatgggcccctcctgaaggacctcctacggcggccaaggcgcagttagctccacgctaggtaactgtgcggctgctggacgccgcccgtgtgctgtgactgtcagacccgtttttcctccaaagttgtgctgtgctgtgctgtctttgataacaaaggttcacggtgagaaagagcagccctctttacacacacatgcatttgctgtcccaggtaagtaacacgcctgagggcaagctgaccacacatggaacatgctgtgcacacacacgtgtgcacactcaccccacacgcacggcacacagcctgaccagacccagcatcgtcagacacaggctcacgatcctggtctttcgggggacacagcttcacttaaaaggcccatcaggaaggaccgtgctttgaaatcaaacgtggttattgcatggtttgtgtggaactggggcccaggcaggtgtgagtgcaggtcttctgtgtgccagccggagcacatagcttgtcgcctctccaacagacatggaggccatgaagacatctgctcctgccagcatccgccgctgccccctggtctaaaagtgggctgacctggggacggcccctcatcagacagatgcgtgctgccggcctcctgccgctccccttgctggtcagacccacagggcccgtgcacatccggggccccagtgggctgtcagaagccatgcaggccccatccgtatggtgacatcctaggcaacatgtcaaggggatgcaagctgggcacgtccagtactaaatcaacccggtccctgtggggtggggcctgccttccctggggcagtgagttcgccttttgttcaagggtctctgggtaccggtatggcgttcgagctcactgcacaggaagccagctacagggaggaagctcgtaggtttcccgtccatggcctgtatccctggggcccctgggttcttccctgggatggtgggacagggggacggtcactctgttggtactgaaaaggagaggccctcattcctagacagagacccctcgcctccatatggcttctctggtggggtggatcccgcccggcctgccctcaggacgagggtgtgtcctgagttgagtctagcagttcctgcaggaggcgatggtagtgagtgcatcccagagtggctcaggtcaccccaggcagccccgtgggtatccctgagactgaccatgtgtctcgttctctcagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 1510 - DNA, 196840 bp, Homo sapiens; identical to SEQ ID NO: 1509
